(12) United States Patent
Zerhusen

(10) Patent No.: US 7,045,509 B2
(45) Date of Patent: May 16, 2006

(54) PROTEINS AND NUCLEIC ACIDS ENCODING SAME

(75) Inventor: Bryan Zerhusen, Branford, CT (US)

(73) Assignee: CuraGen Corporation, New Haven, CT (US)

( * ) Notice: Subject to any disclaimer, the term of this patent is extended or adjusted under 35 U.S.C. 154(b) by 309 days.

(21) Appl. No.: 10/231,913

(22) Filed: Aug. 30, 2002

(65) Prior Publication Data

US 2004/0005576 A1  Jan. 8, 2004

Related U.S. Application Data

(63) Continuation of application No. 10/010,680, filed on Dec. 6, 2001, now abandoned.

(60) Provisional application No. 60/318,712, filed on Sep. 12, 2001, provisional application No. 60/313,627, filed on Aug. 20, 2001, provisional application No. 60/286,183, filed on Apr. 24, 2001, provisional application No. 60/269,942, filed on Feb. 20, 2001, provisional application No. 60/263,800, filed on Jan. 24, 2001, provisional application No. 60/260,326, filed on Jan. 8, 2001, provisional application No. 60/255,029, filed on Dec. 12, 2000, and provisional application No. 60/251,660, filed on Dec. 6, 2000.

(51) Int. Cl.
*A01N 43/04* (2006.01)
*C12P 21/06* (2006.01)
*C12N 1/20* (2006.01)
*C12N 15/00* (2006.01)
*C07H 21/02* (2006.01)

(52) U.S. Cl. ............... 514/44; 435/69.1; 435/252.3; 435/320.1; 536/23.1

(58) Field of Classification Search ............ 435/69.1, 435/252.3, 320.1; 536/23.1; 514/44
See application file for complete search history.

(56) References Cited

PUBLICATIONS

Fakuda et al. [J. Biol. Chem. 274(44):31421–31427, Oct. 29, 1999].*

* cited by examiner

*Primary Examiner*—Tekchand Saidha
(74) *Attorney, Agent, or Firm*—Mei L. Benni; George M. Yahwak; CuraGen Corporation

(57) ABSTRACT

Disclosed are polypeptides and nucleic acids encoding same. Also disclosed are vectors, host cells, antibodies and recombinant methods for producing the polypeptides and polynucleotides, as well as methods for using same.

12 Claims, No Drawings

PROTEINS AND NUCLEIC ACIDS ENCODING SAME

RELATED APPLICATIONS

This application is a continuation of U.S. Ser. No. 10/010,680, filed Dec. 6, 2001, now abandoned, which claims priority from Provisional Applications U.S. Ser. No. 60/251,660, filed Dec. 6, 2000, U.S. Ser. No. 60/260,326, filed Jan. 8, 2001, U.S. Ser. No. 60/318,712, filed Sep. 12, 2001, U.S. Ser. No. 60/255,029, filed Dec. 12, 2000, U.S. Ser. No. 60/263,800, filed Jan. 24, 2001, U.S. Ser. No. 60/286,183, filed Apr. 24, 2001, U.S. Ser. No. 60/269,942, filed Feb. 20, 2001, and U.S. Ser. No. 60/313,627, filed Aug. 20, 2001, each of which is incorporated by reference in its entirety.

FIELD OF THE INVENTION

The invention relates to polynucleotides and the polypeptides encoded by such polynucleotides, as well as vectors, host cells, antibodies and recombinant methods for producing the polypeptides and polynucleotides, as well as methods for using the same.

BACKGROUND OF THE INVENTION

The invention generally relates to nucleic acids and polypeptides encoded therefrom. More specifically, the invention relates to nucleic acids encoding cytoplasmic, nuclear, membrane bound, and secreted polypeptides, as well as vectors, host cells, antibodies, and recombinant methods for producing these nucleic acids and polypeptides.

SUMMARY OF THE INVENTION

The invention is based in part upon the discovery of nucleic acid sequences encoding novel polypeptides. The novel nucleic acids and polypeptides are referred to herein as NOVX, or NOV1, NOV2, NOV3, NOV4, NOV5, NOV6, NOV7, NOV8, NOV9, NOV10, NOV11, NOV12, NOV13, NOV14, NOV15, NOV16, NOV17, NOV18, NOV19, and NOV20 nucleic acids and polypeptides. These nucleic acids and polypeptides, as well as variants, derivatives, homologs, analogs and fragments thereof, will hereinafter be collectively designated as "NOVX" nucleic acid or polypeptide sequences.

In one aspect, the invention provides an isolated NOVX nucleic acid molecule encoding a NOVX polypeptide that includes a nucleic acid sequence that has identity to the nucleic acids disclosed in SEQ ID NOS:1, 3, 5, 7, 9, 11, 13, 15, 17, 19, 21, 23, 25, 27, 29, 31, 33, 35, 37, 39, 41, 43, 45, 47, 49, and 51. In some embodiments, the NOVX nucleic acid molecule will hybridize under stringent conditions to a nucleic acid sequence complementary to a nucleic acid molecule that includes a protein-coding sequence of a NOVX nucleic acid sequence. The invention also includes an isolated nucleic acid that encodes a NOVX polypeptide, or a fragment, homolog, analog or derivative thereof. For example, the nucleic acid can encode a polypeptide at least 80% identical to a polypeptide comprising the amino acid sequences of SEQ ID NOS:2, 4, 6, 8, 10, 12, 14, 16, 18, 20, 22, 24, 26, 28, 30, 32, 34, 36, 38, 40, 42, 44, 46, 48, 50, and 52. The nucleic acid can be, for example, a genomic DNA fragment or a cDNA molecule that includes the nucleic acid sequence of any of SEQ ID NOS: 1, 3, 5, 7, 9, 11, 13, 15, 17, 19, 21, 23, 25, 27, 29, 31, 33, 35, 37, 39, 41, 43, 45, 47, 49, and 51.

Also included in the invention is an oligonucleotide, e.g., an oligonucleotide which includes at least 6 contiguous nucleotides of a NOVX nucleic acid (e.g., SEQ ID NOS: 1, 3, 5, 7, 9, 11, 13, 15, 17, 19, 21, 23, 25, 27, 29, 31, 33, 35, 37, 39, 41, 43, 45, 47, 49, and 51) or a complement of said oligonucleotide.

Also included in the invention are substantially purified NOVX polypeptides (SEQ ID NOS: 2, 4, 6, 8, 10, 12, 14, 16, 18, 20, 22, 24, 26, 28, 30, 32, 34, 36, 38, 40, 42, 44, 46, 48, 50, and 52). In certain embodiments, the NOVX polypeptides include an amino acid sequence that is substantially identical to the amino acid sequence of a human NOVX polypeptide.

The invention also features antibodies that immunoselectively bind to NOVX polypeptides, or fragments, homologs, analogs or derivatives thereof.

In another aspect, the invention includes pharmaceutical compositions that include therapeutically- or prophylactically-effective amounts of a therapeutic and a pharmaceutically-acceptable carrier. The therapeutic can be, e.g., a NOVX nucleic acid, a NOVX polypeptide, or an antibody specific for a NOVX polypeptide. In a further aspect, the invention includes, in one or more containers, a therapeutically- or prophylactically-effective amount of this pharmaceutical composition.

In a further aspect, the invention includes a method of producing a polypeptide by culturing a cell that includes a NOVX nucleic acid, under conditions allowing for expression of the NOVX polypeptide encoded by the DNA. If desired, the NOVX polypeptide can then be recovered.

In another aspect, the invention includes a method of detecting the presence of a NOVX polypeptide in a sample. In the method, a sample is contacted with a compound that selectively binds to the polypeptide under conditions allowing for formation of a complex between the polypeptide and the compound. The complex is detected, if present, thereby identifying the NOVX polypeptide within the sample.

The invention also includes methods to identify specific cell or tissue types based on their expression of a NOVX.

Also included in the invention is a method of detecting the presence of a NOVX nucleic acid molecule in a sample by contacting the sample with a NOVX nucleic acid probe or primer, and detecting whether the nucleic acid probe or primer bound to a NOVX nucleic acid molecule in the sample.

In a further aspect, the invention provides a method for modulating the activity of a NOVX polypeptide by contacting a cell sample that includes the NOVX polypeptide with a compound that binds to the NOVX polypeptide in an amount sufficient to modulate the activity of said polypeptide. The compound can be, e.g., a small molecule, such as a nucleic acid, peptide, polypeptide, peptidomimetic, carbohydrate, lipid or other organic (carbon containing) or inorganic molecule, as further described herein.

Also within the scope of the invention is the use of a therapeutic in the manufacture of a medicament for treating or preventing disorders or syndromes including, e.g., those described for the individual NOVX nucleotides and polypeptides herein, and/or other pathologies and disorders of the like.

The therapeutic can be, e.g., a NOVX nucleic acid, a NOVX polypeptide, or a NOVX-specific antibody, or biologically-active derivatives or fragments thereof. For example, the compositions of the present invention will have efficacy for treatment of patients suffering from the diseases and disorders disclosed above and/or other pathologies and disorders of the like. The polypeptides can be used as immunogens to produce antibodies specific for the invention, and as vaccines. They can also be used to screen for potential agonist and antagonist compounds. For example, a cDNA encoding NOVX may be useful in gene therapy, and NOVX may be useful when administered to a subject in need thereof. By way of non-limiting example, the compositions of the present invention will have efficacy for treatment of patients suffering from the diseases and disorders disclosed above and/or other pathologies and disorders of the like.

The invention further includes a method for screening for a modulator of disorders or syndromes including, e.g., the diseases and disorders disclosed above and/or other pathologies and disorders of the like. The method includes contacting a test compound with a NOVX polypeptide and determining if the test compound binds to said NOVX polypeptide. Binding of the test compound to the NOVX polypeptide indicates the test compound is a modulator of activity, or of latency or predisposition to the aforementioned disorders or syndromes.

Also within the scope of the invention is a method for screening for a modulator of activity, or of latency or predisposition to an disorders or syndromes including, e.g., the diseases and disorders disclosed above and/or other pathologies and disorders of the like by administering a test compound to a test animal at increased risk for the aforementioned disorders or syndromes. The test animal expresses a recombinant polypeptide encoded by a NOVX nucleic acid. Expression or activity of NOVX polypeptide is then measured in the test animal, a is expression or activity of the protein in a control animal which recombinantly-expresses NOVX polypeptide and is not at increased risk for the disorder or syndrome. Next, the expression of NOVX polypeptide in both the test animal and the control animal is compared. A change in the activity of NOVX polypeptide in the test animal relative to the control animal indicates the test compound is a modulator of latency of the disorder or syndrome.

In yet another aspect, the invention includes a method for determining the presence of or predisposition to a disease associated with altered levels of a NOVX polypeptide, a NOVX nucleic acid, or both, in a subject (e.g., a human subject). The method includes measuring the amount of the NOVX polypeptide in a test sample from the subject and comparing the amount of the polypeptide in the test sample to the amount of the NOVX polypeptide present in a control sample. An alteration in the level of the NOVX polypeptide in the test sample as compared to the control sample indicates the presence of or predisposition to a disease in the subject. Preferably, the predisposition includes, e.g., the diseases and disorders disclosed above and/or other pathologies and disorders of the like. Also, the expression levels of the new polypeptides of the invention can be used in a method to screen for various cancers as well as to determine the stage of cancers.

In a further aspect, the invention includes a method of treating or preventing a pathological condition associated with a disorder in a mammal by administering to the subject a NOVX polypeptide, a NOVX nucleic acid, or a NOVX-specific antibody to a subject (e.g., a human subject), in an amount sufficient to alleviate or prevent the pathological condition. In preferred embodiments, the disorder, includes, e.g., the diseases and disorders disclosed above and/or other pathologies and disorders of the like.

In yet another aspect, the invention can be used in a method to identity the cellular receptors and downstream effectors of the invention by any one of a number of techniques commonly employed in the art. These include but are not limited to the two-hybrid system, affinity purification, co-precipitation with antibodies or other specific-interacting molecules.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and not intended to be limiting.

Other features and advantages of the invention will be apparent from the following detailed description and claims.

DETAILED DESCRIPTION OF THE INVENTION

The present invention provides novel nucleotides and polypeptides encoded thereby. Included in the invention are the novel nucleic acid sequences and their polypeptides. The sequences are collectively referred to as "NOVX nucleic acids" or "NOVX polynucleotides" and the corresponding encoded polypeptides are referred to as "NOVX polypeptides" or "NOVX proteins." Unless indicated otherwise, "NOVX" is meant to refer to any of the novel sequences disclosed herein. Table A provides a summary of the NOVX nucleic acids and their encoded polypeptides.

TABLE A

Sequences and Corresponding SEQ ID Numbers

| NOVX | Internal Identification | SEQ ID NO (nt) | SEQ ID NO (aa) | Homology |
|---|---|---|---|---|
| 1 | GSAC055740_A | 1 | 2 | Processing α-1, 2-Mannosidase |
| 2 | GSAC055740_B | 3 | 4 | Ion Transporter |
| 3 | GSAC068993_A | 5 | 6 | Ras-Related |
| 4 | GSAC022510_A | 7 | 8 | Ser/Thr Protein Kinase |
| 5 | GSAC022509_A | 9 | 10 | SHARP1 - Ser/Thr |
| 6 | GSAC023158.15_A | 11 | 12 | Synaptotagmin X |
| 7 | GSAC055715_A | 13 | 14 | Type II Cytokeratin |
| 8a | 134929133_EXT | 15 | 16 | EGF-rel/CEGP1/ SCUBE1 |
| 8b | CG50979-02 | 17 | 18 | EGF-rel/CEGP1/ SCUBE1 |
| 9a | GSAC046130_A | 19 | 20 | Potassium Channel Regulatory Subunit |
| 9b | CG56017-01 | 21 | 22 | Potassium Channel Regulatory Subunit |
| 10a | 28477694_A | 23 | 24 | Faciogenital Dysplasia Protein |
| 10b | CG110519-01 | 25 | 26 | Faciogenital Dysplasia Protein |
| 11 | SC111743377_A | 27 | 28 | Steroid Dehydrogenase |
| 12 | 418354_0_9_da1 | 29 | 30 | SEC6 |
| 13 | CG50179-01 | 31 | 32 | Type II Cytokeratin |
| 14 | 95073892_da1 | 33 | 34 | Protein Kinase SNF1LK |
| 15a | ba294a4_20000808 | 35 | 36 | CD39L2 |
| 15b | CG50163-02 | 37 | 38 | CD39L2 |
| 16 | 61116029 | 39 | 40 | P450 |
| 17 | AC004596_A | 41 | 42 | CG13379 |
| 18 | AC073079_C | 43 | 44 | Calcium Transporter |

TABLE A-continued

Sequences and Corresponding SEQ ID Numbers

| NOVX | Internal Identification | SEQ ID NO (nt) | SEQ ID NO (aa) | Homology |
|---|---|---|---|---|
| 19a | MBNM_004056_da2 | 45 | 46 | Carbonic Anhydrase |
| 19b | CG50157-02 | 47 | 48 | Carbonic Anhydrase |
| 20a | AC018946.4_A | 49 | 50 | GABA Receptor Associated |
| 20b | CG56872-02 | 51 | 52 | GABA Receptor Associated |

NOVX nucleic acids and their encoded polypeptides are useful in a variety of applications and contexts. The various NOVX nucleic acids and polypeptides according to the invention are useful as novel members of the protein families according to the presence of domains and sequence relatedness to previously described proteins. Additionally, NOVX nucleic acids and polypeptides can also be used to identify proteins that are members of the family to which the NOVX polypeptides belong.

The NOVX genes and their corresponding encoded proteins are useful for preventing, treating or ameliorating medical conditions, e.g., by protein or gene therapy. Pathological conditions can be diagnosed by determining the amount of the new protein in a sample or by determining the presence of mutations in the new genes. Specific uses are described for each of the sixteen genes, based on the tissues in which they are most highly expressed. Uses include developing products for the diagnosis or treatment of a variety of diseases and disorders.

The NOVX nucleic acids and polypeptides can also be used to screen for molecules, which inhibit or enhance NOVX activity or function. Specifically, the nucleic acids and polypeptides according to the invention may be used as targets for the identification of small molecules that modulate or inhibit, e.g., neurogenesis, cell differentiation, cell proliferation, hematopoiesis, wound healing and angiogenesis.

In one embodiment of the present invention, NOVX or a fragment or derivative thereof may be administered to a subject to treat or prevent a disorder associated with decreased expression or activity of NOVX. Examples of such disorders include, but are not limited to, cancers such as adenocarcinoma, leukemia, lymphoma, melanoma, myeloma, sarcoma, teratocarcinoma, and, in particular, cancers of the adrenal gland, bladder, bone, bone marrow, brain, breast, cervix, gall bladder, ganglia, gastrointestinal tract, heart, kidney, liver, lung, muscle, ovary, pancreas, parathyroid, penis, prostate, salivary glands, skin, spleen, testis, thymus, thyroid, and uterus; neurological disorders such as epilepsy, ischemic cerebrovascular disease, stroke, cerebral neoplasms, Alzheimer's disease, Pick's disease, Huntington's disease, dementia, Parkinson's disease and other extrapyramidal disorders, amyotrophic lateral sclerosis and other motor neuron disorders, progressive neural muscular atrophy, retinitis pigmentosa, hereditary ataxias, multiple sclerosis and other demyelinating diseases, bacterial and viral meningitis, brain abscess, subdural empyema, epidural abscess, suppurative intracranial thrombophlebitis, myelitis and radiculitis, viral central nervous system disease, prion diseases including kuru, Creutzfeldt-Jakob disease, and Gerstmann-Straussler-Scheinker syndrome, fatal familial insomnia, nutritional and metabolic diseases of the nervous system, neurofibromatosis, tuberous sclerosis, cerebelloretinal hemangioblastomatosis, encephalotrigeminal syndrome, mental retardation and other developmental disorders of the central nervous system, cerebral palsy, neuroskeletal disorders, autonomic nervous system disorders, cranial nerve disorders, spinal cord diseases, muscular dystrophy and other neuromuscular disorders, peripheral nervous system disorders, dermatomyositis and polymyositis, inherited, metabolic, endocrine, and toxic myopathies, myasthenia gravis, periodic paralysis, mental disorders including mood, anxiety, and schizophrenic disorders, akathesia, amnesia, catatonia, diabetic neuropathy, tardive dyskinesia, dystonias, paranoid psychoses, postherpetic neuralgia, and Tourette's disorder; and disorders of vesicular transport such as cystic fibrosis, glucose-galactose malabsorption syndrome, hypercholesterolemia, diabetes mellitus, diabetes insipidus, hyper- and hypoglycemia, Grave's disease, goiter, Cushing's disease, Addison's disease, gastrointestinal disorders including ulcerative colitis, gastric and duodenal ulcers, other conditions associated with abnormal vesicle trafficking including acquired immunodeficiency syndrome (AIDS), allergic reactions, autoimmune hemolytic anemia, proliferative glomerulonephritis, inflammatory bowel disease, multiple sclerosis, myasthenia gravis, rheumatoid arthritis, osteoarthritis, scleroderma, Chediak-Higashi syndrome, Sjogren's syndrome, systemic lupus erythiematosus, toxic shock syndrome, traumatic tissue damage, and viral, bacterial, fungal, helminthic, and protozoal infections, as well as additional indications listed for the individual NOVX clones.

The NOVX nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed. These also include potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), (v) an agent promoting tissue regeneration in vitro and in vivo, and (vi) a biological defense weapon.

Additional utilities for the NOVX nucleic acids and polypeptides according to the invention are disclosed herein.

NOV1

A disclosed NOV1 nucleic acid (SEQ ID NO:1) of 2331 nucleotides (also referred to as GSAC055740_A) encoding a novel Processing Alpha-1,2-Mannosidase-like protein is shown in Table 1A. An open reading frame was identified beginning with an ATG initiation codon at nucleotides 71–73 and ending with a TAA codon at nucleotides 2278–2280. Putative untranslated regions are found upstream from the initiation codon and downstream from the termination codon, and are underlined. The start and stop codons are shown in bold letters in Table 1A.

TABLE 1A

NOV1 nucleotide sequence (SEQ ID NO:1).

CAGTTCAATGTATTCTACATTTGACATAAGATGAGAACTTTCTAAAGTATTCTCTCCAAGAGCGTAAACG

ATGACTACCCCAGCCCTGCTGCCCCTCTCTGGACGTAGGATACCACCTCTGAACCTGGGGCCGCCTTCCT

TCCCACATCACAGGGCTACCTTGAGACTTTCTGAGAAGTTTATTCTTCTCCTTATTCTTAGTGCCTTCAT

CACTCTGTGTTTTGGGGCATTCTTTTTCCTTCCAGACTCTTCAAAACACAAACGCTTTGATTTGGGTTTA

GAAGATATGGACCCGATGAACATAGACACAGGAAGTTCACAAATGGGTGCTACCATAGTAGATGCTTTGG

ATACCCTTTATATCATGGGACTTCATGATGAATTCCTAGATGGGCAAAGATGGATTGAAGACAACCTTGA

TTTCAGTGTGAATTCAGAGGTGTCTGTGTTTGAAGTCAACATTCGATTTATTGGAGGCCTACTTGCAGCA

TATTACCTATCAGGAGAGGAGATATTCAAGATTAAAGCAGTGCAATTGGCTGAGAAACTCCTTCCTGCCT

TTAACACACCTACTGGGATTCCTTGGGCAATGGTGAATTTGAAAAGTGGAGTAGGGCGAAACTGGGGCTG

GGCATCTGCAGGTAGCAGCATTCTGGCTGAATTTGGTACACTACATATGGAGTTCATCCACCTCAGCTAC

TTGACAGGGGACCTGACTTACTACAAAAAGGTTATGCACATTCGGAAACTACTTCAGAAAATGGATCGTC

CAAATGGTCTTTATCCAAATTATTTGAACCCCAGAACAGGGCGCTGGGGTCAGTATCATACATCTGTCGG

TGGCCTGGGAGACAGTTTTTATGAATACTTACTGAAAGCATGGTTGATGTCAGATAAAACAGACCATGAG

GCAAGAAAGATGTATGATGATGCTATTGAGGCTATAGAAAAACATCTTATTAAGAAGTCTCGTGGAGGTC

TTACCTTTATTGGAGAATGGAAGAATGGGCACTTGGAAAAAAAGATGGGGCATTTGGCCTGCTTTGCTGG

GGGAATGTTTGCACTAGGAGCAGATGGTTCCAGAGCAGATAAAGCTGGTCATTATTTAGAGCTAGGGGCA

GAAATTGCACGTACTTGTCATGAGTCATATGACAGAACTGCATTAAAGCTAGGTCCTGAATCATTGCGGA

GTATGCAGTCCCAGGCTTTTCGAATTAGTCAAAACACTGGCCCCCCACCAATTGACCGTCAAAAGAGATT

ATCTTACCCACCAGTTCAGAGCATCCCAACAGGAAATGGTATTCCATCAAGGGACAGTGAAAATACTTGT

CACCAAAGTTTCATGCAGAGCTTACTTGCCCCTCACCTCAGTGATCAGGTCATTGGGAGCCAGAGGTCAC

TCTCAGAACATCAGAGGAATACACAGTGTGGTCCATCCTCTGCAATTGAATATAATTGTCCCCCAACTCA

TGAAAATGTCCATATTAGAAGAGAGAGTGAGAGTCAGAATAGGGAAAGTTGTGACATGTCGTTAGGTGCA

ATTAACACCAGGAACAGCACCTTGAATATTCCTTTTTCAAGTTCCTCTTCCTCAGGAGATATTCAAGGTC

GAAACACAAGCCCCAATGTTTCTGTACAGAAATCCAATCCCATGAGGATTACTGAGAGTCATGCCACCAA

GGGCCACATGAACCCTCCAGTCACAACCAACATGCATGGGGTTGCAAGGCCAGCGTTGCCACATCCATCT

GTGTCTCATGGAAATGGCGATCAAGGCCCTGCTGTACGTCAAGCTAATTCTTCAGTTCCCCAGAGATCAA

GGCATCCCCTGCAAGACAGCAGTGGTTCCAAAATTCGTCAGCCTGAAAGGAATCGTTCTGGAAACCAAAG

GCAAAGTACTGTCTTTGATCCAAGTCTTCCCCATCTTTCTCTCTACTGGTGGCAGTATGATTCTTGGA

CGTCAACAACCTGCCACAGAGAAGAGAGGAAGTATTGTTCGTTTCATGCCTGATAGCCCACAAGTACCTA

ATGATAATTCAGGTCCTGACCAGCATACACTATCACAAAATTTTGGTTTTTCTTTTATTCCTGAGGGTGG

CATGAATCCACCAATAAATGCTAATGCTTCTTTCATTCCCCAGGTTACTCAGCCTAGTGCCACTCGCACT

CCAGCCTGGGCAACAGAGCCAGACTCCATCTATTAAAATTTGAAAACTAAAAAAACTCCTGCTCATC

CTACACTGTCCAATGATATTTCAATCCCCTATTTTCCTAATCAGATGTTCTCAAATCCTAGGCACAGAGG

AAGGGTAAACAGTGGGGAGGT

The NOV1 sequence of the invention was derived by laboratory cloning of cDNA fragments covering the full length and/or part of the DNA sequence of the invention, and/or by in silico prediction of the full length and/or part of the DNA sequence of the invention from public human sequence databases.

A disclosed NOV1 polypeptide (SEQ ID NO:2) encoded by SEQ ID NO:1 has 711 amino acid residues and is presented in Table 1B using the one-letter amino acid code. NOV1 has an INTEGRAL likelihood of −9.66 that it is a transmembrane protein, and appears to be a Type II (Ncyt Cexo) membrane protein. SignalP, Psort and/or Hydropathy results predict that NOV1 has a signal peptide and is likely to be localized to the plasma membrane with a certainty of 0.7900. In an alternative embodiment, NOV1 is likely to be localized to the Golgi body with a certainty of 0.3000, or to the nucleus with a certainty of 0.3000, or to the endoplasmic reticulum (membrane) with a certainty of 0.2000. The most likely cleavage site for a NOV1 peptide is between amino acids 52 and 53, i.e., at the dash between amino acids CFG-AF. NOV1 has a molecular weight of 78450.27 Daltons.

sequence for a novel Processing Alpha-1,2-Mannosidase-like gene or one of its splice forms thus derived is reported here as CuraGen Acc. No. NOV1 GSAC055740_A.

In all BLAST alignments herein, the "E-value" or "Expect" value is a numeric indication of the probability that the aligned sequences could have achieved their similarity to the BLAST query sequence by chance alone, within the database that was searched. The Expect value (E) is a parameter that describes the number of hits one can "expect" to see just by chance when searching a database of a

TABLE 1B

Encoded NOV1 protein sequence (SEQ ID NO:2).

MTTPALLPLSGRRIPPLNLGPPSFPHHRATLRLSEKFILLLILSAFITLCFGAFFFLPDSSKHKRFDLGL

EDMDPMNIDTGSSQMGATIVDALDTLYIMGLHDEFLDGQRWIEDNLDFSVNSEVSVFEVNIRFIGGLLAA

YYLSGEEIFKIKAVQLAEKLLPAFNTPTGIPWAMVNLKSGVGRNWGWASAGSSILAEFGTLHMEFIHLSY

LTGDLTYYKKVMHIRKLLQKMDRPNGLYPNYLNPRTGRWGQYHTSVGGLGDSFYEYLLKAWLMSDKTDHE

ARKMYDDAIEAIEKHLIKKSRGGLTFIGEWKNGHLEKKMGHLACFAGGMFALGADGSRADKAGHYLELGA

EIARTCHESYDRTALKLGPESLRSMQSQAFRISQNTGPPPIDRQKRLSYPPVQSIPTGNGIPSRDSENTC

HQSFMQSLLAPHLSDQVIGSQRSLSEHQRNTQCGPSSAIEYNCPPTHENVHIRRESESQNRESCDMSLGA

INTRNSTLNIPFSSSSSSGDIQGRNTSPNVSVQKSNPMRITESHATKGHMNPPVTTNMHGVARPALPHPS

VSHGNGDQGPAVRQANSSVPQRSRHPLQDSSGSKIRQPERNRSGNQRQSTVFDPSLPHLSLSTGGSMILG

RQQPATEKRGSIVRFMPDSPQVPNDNSGPDQHTLSQNFGFSFIPEGGMNPPINANASFIPQVTQPSATRT

PAWATEPDSIY

NOV1 GSAC055740_A genomic clones on chromosome 3 were identified by TBLASTN using proprietary sequence file for members of Processing Alpha-1,2-Mannosidase and/or Processing Alpha-1,2-Mannosidase family, run against the genomic daily files made available by GenBank or obtained from Human Genome Project Sequencing centers. These genomic clones were analyzed by Genscan and Grail and other programs to identify regions that were putative exons i.e. putative coding sequences. These clones were also analyzed by BLASTN, TBLASTN, TFASTN, TFASTA, BLASTX and/or other programs to identify genomic regions with DNA similarity or translating to proteins with similarity to the original protein or protein family of interest.

The regions defined by all approaches were then manually integrated and manually corrected for apparent inconsistencies that may have arisen, for example, from discrepancies between predicted exon junctions and regions of predicted homology to a protein of similarity, to derive the final nucleotide sequence reported here. When necessary, the process to identify and analyze genomic clones was reiterated to derive the full length sequence. Sequences from the following sources were thus included in the invention: NOV1 GSAC055740_A. The DNA sequence and protein particular size. It decreases exponentially with the Score (S) that is assigned to a match between two sequences. Essentially, the E value describes the random background noise that exists for matches between sequences.

The Expect value is used as a convenient way to create a significance threshold for reporting results. The default value used for blasting is typically set to 0.0001, with the filter to remove low complexity sequence turned off. In BLAST 2.0, the Expect value is also used instead of the P value (probability) to report the significance of matches. For example, an E value of one assigned to a hit can be interpreted as meaning that in a database of the current size one might expect to see one match with a similar score simply by chance. An E value of zero means that one would not expect to see any matches with a similar score simply by chance. See, e.g., http://www.ncbi.nlm.nih.gov/Education/BLASTinfo/.

BLAST analysis was performed on sequences from the Patp database, which is a proprietary database that contains sequences published in patents and patent publications. Patp results include those listed in Table 1C.

TABLE 1C

Patp BLASTP Analysis for NOV1

| Sequences Producing High-scoring Segment Pairs | Protein/Organism | Length (aa) | Identity (%) | Positive (%) | E Value |
|---|---|---|---|---|---|
| patp: AAB94529 | Human protein sequence clone no: 15260 - *Homo sapiens* | 617 | 617/617 (100%) | 617/617 (100%) | 0.0 |

TABLE 1C-continued

Patp BLASTP Analysis for NOV1

| Sequences Producing High-scoring Segment Pairs | Protein/Organism | Length (aa) | Identity (%) | Positive (%) | E Value |
|---|---|---|---|---|---|
| patp: AAB93501 | Human protein sequence clone no: 12820 - *Homo sapiens* | 287 | 197/200 (98%) | 198/200 (99%) | 1.0e−107 |
| patp: AAB80283 | Human prostate cancer antigen #11 - *Homo sapiens* | 449 | 180/312 (57%) | 247/312 (79%) | 8.1e−99 |
| patp: AAB80352 | Human prostate cancer antigen #80 - *Homo sapiens* | 478 | 180/312 (57%) | 247/312 (79%) | 8.1e−99 |
| patp: AAW48265 | Sf9 alpha-mannosidase I - Lepidoptera | 655 | 152/318 (47%) | 226/318 (71%) | 3.7e−88 |

In a search of sequence databases, it was found, for example, that the nucleic acid sequence of this invention has 881 of 885 bases (99%) identical to a gb:GenBank-ID:AF0271561| acc:AF027156 mRNA from *Homo sapiens* (*Homo sapiens* alpha 1,2-mannosidase IB mRNA, complete cds). The full amino acid sequence of the protein of the invention was found to have 291 of 293 amino acid residues (99%) identical to, and 292 of 293 amino acid residues (99%) similar to, the 641 amino acid residue ptnr:SptrEmbl-ACC:060476 protein from *Homo sapiens* (Alpha-1,2-Mannosidase IB).

In a further search of public sequence databases, NOV1 was found to have homology to the amino acid sequences shown in the BLASTP data listed in Table 1D. Clone AK023308 (Acc. No. gi|10435187) was shown to have 100% homology across 618 of the 711 amino acids of the full length NOV1 polypeptide.

The homology of these and other sequences is shown graphically in the ClustalW analysis shown in Table 1E. In the ClustalW alignment of the NOV1 protein, as well as all other ClustalW analyses herein, the black outlined amino acid residues indicate regions of conserved sequence (i.e., regions that may be required to preserve structural or functional properties), whereas non-highlighted amino acid residues are less conserved and can potentially be mutated to a much broader extent without altering protein structure or function. NOV1 polypeptide is provided in lane 1.

TABLE 1D

BLASTP results for NOV1

| Gene Index/ Identifier | Protein/Organism | Length (aa) | Identity (%) | Positives (%) | Expect |
|---|---|---|---|---|---|
| gi|10435187| dbj|BAB14518.1| AK023308 | unnamed protein product [*Homo sapiens*] | 618 | 618/618 (100%) | 618/618 (100%) | 0.0 |
| gi|14748660| ref|XP_040721.1| XM_040721 | mannosidase, alpha, class 1A, member 2 [*Homo sapiens*] | 452 | 290/292 (99%) | 291/292 (99%) | e−179 |
| gi|3127047| gb|AAC26169.1| AF027156 | alpha 1,2-mannosidase IB [*Homo sapiens*] | 641 | 291/293 (99%) | 291/293 (99%) | e−176 |
| gi|6754620| ref|NP_034893.1| NM_010763 | mannosidase 1, beta [*Mus musculus*] | 641 | 280/293 (95%) | 288/293 (97%) | e−172 |
| gi|1083217| pir||A54407 | alpha-mannosidase (EC 3.2.1.24) - mouse | 641 | 278/293 (94%) | 286/293 (96%) | e−170 |

TABLE 1E

ClustalW Analysis of NOV1

1) Novel NOV1 (SEQ ID NO:2)
2) gi|10435187 (SEQ ID NO:53)
3) gi|14748660 (SEQ ID NO:54)
4) gi|3127047 (SEQ ID NO:55)
5) gi|6754620 (SEQ ID NO:56)
6) gi|1083217 (SEQ ID NO:57)

```
                        10         20         30         40         50
                 ....|....|....|....|....|....|....|....|....|....|
NOV1 GSAC055740_A MTTPALLPLSGRRIPPLNLGPPSFPHHRATLRLSEKFILLLILSAFITLC
gi|10435187      --------------------------------------------------
gi|14748660      --------------------------------------------------
gi|3127047       MTTPALLPLSGRRIPPLNLGPPSFPHHRATLRLSEKFILLLILSAFITLC
gi|6754620       MTTPALLPLSGRRIPPLNLGPPSFPHHRATLRLSEKFILLLILSAFITLC
gi|1083217       MTTPALLPLSGRRIPPLNLGPPSFPHHRATLRLSEKFILLLILSAFITLC 60         70         80         90        100
                 ....|....|....|....|....|....|....|....|....|....|
NOV1 GSAC055740_A FGAFFFLPDSSKHKRFDLG-------------------------------
gi|10435187      --------------------------------------------------
gi|14748660      --------------------------------------------------
gi|3127047       FGAFFFLPDSSKHKRFDLGLEDVLIPHVDAGKGAKNPGVFLIHGPDEHRH
gi|6754620       FGAFFFLPDSSKHKRFDLGLEDVLIPHVDAGKGAKNPGVFLIHGPDEHRH
gi|1083217       FGAFFFLPDSSKHKRFDLGLEDVLIPHVDAGKGAKNPGVFLIHGPDEHRH 110        120        130        140        150
                 ....|....|....|....|....|....|....|....|....|....|
NOV1 GSAC055740_A --------------------------------------------------
gi|10435187      --------------------------------------------------
gi|14748660      --------------------------------------------------
gi|3127047       REEEERLRNKIRADHEKALEEAKEKLRKSREEIRAEIQTEKNKVVQEMKI
gi|6754620       REEEERLRNKIRADHEKALEEAKEKLRKSREEIRAEIQTEKNKVAQAMKT
gi|1083217       REEEERLRNKIRADHEKALEEAKEKLRKSREEIRAEIQTEKNKVAQAMKT 160        170        180        190        200
                 ....|....|....|....|....|....|....|....|....|....|
NOV1 GSAC055740_A -----L-ED----------MDPMN----------------------IDT-
gi|10435187      -------------------MDPMN----------------------IDT-
gi|14748660      ---------MLGITIGHMGGDIMNSDLLQ--GK---------DTPLTY--
gi|3127047       KENKPLPPVPIPNLVGIRGGDPEDNDIREKREKIKEMMKHAWDNYRTYGW
gi|6754620       KETRVLPPVPVPQRVGVSGGDPEDMEIKKKRDKIKEMMKHAWDNYRTYGW
gi|1083217       KETRVLPPVPVPQRVGVSGGDPEDMEIKKKRDKIKEMMKHAWDNYRTYGW 210        220        230        240        250
                 ....|....|....|....|....|....|....|....|....|....|
NOV1 GSAC055740_A -------------------GSSQMGATIVDALDTLYIMGLHDEFLDGQRWI
gi|10435187      -------------------GSSQMGATIVDALDTLYIMGLHDEFLDGQRWI
gi|14748660      ------------------L-VSSQMGATIVDALDTLYIMGLHDEFLDGQRWI
gi|3127047       GHNELRPIARKGHSPNIFGSSQMGATIVDALDTLYIMGLHDEFLDGQRWI
gi|6754620       GHNELRPIARKGHSPNIFGSSQMGATIVDALDTLYIMGLHDEFMDGQRWI
gi|1083217       GHNELRPIARKGHSPNIFGSSQMGATIVDALDTLYIMGLHDEFMDGQRWI 260        270        280        290        300
                 ....|....|....|....|....|....|....|....|....|....|
NOV1 GSAC055740_A EDNLDFSVNSEVSVFEVNIRFIGGLLAAYYLSGEEIFKIKAVQLAEKLLP
gi|10435187      EDNLDFSVNSEVSVFEVNIRFIGGLLAAYYLSGEEIFKIKAVQLAEKLLP
gi|14748660      EDNLDFSVNSEVSVFEVNIRFIGGLLAAYYLSGEEIFKIKAVQLAEKLLP
gi|3127047       EDNLDFSVNSEVSVFEVNIRFIGGLLAAYYLSGEEIFKIKAVQLAEKLLP
gi|6754620       ENLDFSVNSEVSVFEVNIRFIGGLLAAYYLSGEEIFKTKAVQLAEKLLP
gi|1083217       ENLDFSVNSEVSVFEVNIRFIGGLLAAYYLSGEEIFKTKAVQLAEKLLP 310        320        330        340        350
                 ....|....|....|....|....|....|....|....|....|....|
NOV1 GSAC055740_A AFNTPTGIPWAMVNLKSGVGRNWGWASAGSSILAEFGTLHMEFIHLSYLT
gi|10435187      AFNTPTGIPWAMVNLKSGVGRNWGWASAGSSILAEFGTLHMEFIHLSYLT
gi|14748660      AFNTPTGIPWAMVNLKSGVGRNWGWASAGSSILAEFGTLHMEFIHLSYLT
gi|3127047       AFNTPTGIPWAMVNLKSGVGRNWGWASAGSSILAEFGTLHMEFIHLSYLT
gi|6754620       AFNTPTGIPWAMVNLKSGVGRNWGWASAGSSILAEFGTLHMEFVHLSYLT
gi|1083217       AFNTPTGIPWAMVNLKSGVGRNWGWASAGSSILAEFGTLHMEFVHLSYLT 360        370        380        390        400
                 ....|....|....|....|....|....|....|....|....|....|
NOV1 GSAC055740_A GDLTYYKKVMHIRKLLQKMDRPNGLYPNYLNPRTGRWGQYHTSVGGLGDS
gi|10435187      GDLTYYKKVMHIRKLLQKMDRPNGLYPNYLNPRTGRWGQYHTSVGGLGDS
gi|14748660      GDLTYYKKVMHIRKLLQKMDRPNGLYPNYLNPRTGRWGQYHTSVGGLGDS
gi|3127047       GDLTYYKKVMHIRKLLQKMDRPNGLYPNYLNPRTGRWGQYHTSVGGLGDS
gi|6754620       GDLTYYNKVMHIRKLLQKMDRPNGLYPNYLNPRTGRWGQYHTSVGGLGDS
gi|1083217       GDLTYYNKVMHIRKLLQKMDRPNGLYPNYLNPRTGRWGQYHTSVGGLGDS
```

TABLE 1E-continued

ClustalW Analysis of NOV1

```
                      410        420        430        440        450
                       ....|....|....|....|....|....|....|....|....|....|
NOV1 GSAC055740_A     FYEYLLKAWLMSDKTDHEARKMYDDAIEAIEKHLIKKSRGGLTFIGEWKN
gi|10435187|          FYEYLLKAWLMSDKTDHEARKMYDDAIEAIEKHLIKKSRGGLTFIGEWKN
gi|14748660|          FYEYLLKAWLMSDKTDHEARKMYDDAIEAIEKHLIKKSRGGLTFIGEWKN
gi|3127047|           FYEYLLKAWLMSDKTDHEARKMYDDAIEAIEKHLIKKSRGGLTFIGEWKN
gi|6754620            FYEYLLKAWLMSDKTDHEARRMYDDAVEAIEKHLIKKSRGGLVFIGEWKN
gi|1083217|           FYEYLLKAWLTSDKTDHEARRMYDDAVEAIEKHLIKKSRGGLVFIGEWKN 460        470        480        490        500
                       ....|....|....|....|....|....|....|....|....|....|
NOV1 GSAC055740_A     GHLEKKMGHLACFAGGMFALGADGSRADKAGHYLELGAEIARTCHESYDR
gi|10435187|          GHLEKKMGHLACFAGGMFALGADGSRADKAGHYLELGAEIARTCHESYDR
gi|14748660|          GHLEKKMGHLACFAGGMFALGADGSRADKAGHYLELGAEIARTCHESYDR
gi|3127047|           GHLEKKMGHLACFAGGMFALGADGSRADKAGHYLELGAEIARTCHESYDR
gi|6754620            GHLERKMGHLACFAGGMFALGADGSRKDKAGHYLELGAEIARTCHESYDR
gi|1083217|           GHLERKMGHLACFAGGMLALGADGSRKDKAGHYLELGAEIARTCHESYDR 510        520        530        540        550
                       ....|....|....|....|....|....|....|....|....|....|
NOV1 GSAC055740_A     TALKLGPESLRSMQSQAFRISQNTGPPPIDRQKRLSYPPVQSIPTGNGIP
gi|10435187|          TALKLGPESLRSMQSQAFRISQNTGPPPIDRQKRLSYPPVQSIPTGNGIP
gi|14748660|          TALKLGPESFR---------------FDG------AVEAVAVR----
gi|3127047|           TALKLGPESFR---------------FDG------AVEAVAVR----
gi|6754620            TALKLGPESFR---------------FDG------AVEAVAVR----
gi|1083217|           TALKLGPESFR---------------FDG------AVEAVAVR----

560        570        580        590        600
                       ....|....|....|....|....|....|....|....|....|....|
NOV1 GSAC055740_A     SRDSENTCHQSFMQSLLAEHLSDQVIGSQRSLSEHQRNTQCGPSSAIEYN
gi|10435187|          SRDSENTCHQSFMQSLLAEHLSDQVIGSQRSLSEHQRNTQCGPSSAIEYN
gi|14748660|          ---------QARKYYILRPEVIETYWYLWR-FTHDPRYRQWG---------
gi|3127047|           ---------QARKYYILRPEVIETYWYLWR-FTHDPRYRQWG---------
gi|6754620            ---------QARKYYILRPEVIETYWYLWR-FTHDPRYRQWG---------
gi|1083217|           ---------QARKYYILRPEVIETYWYLWR-FTHDPRYRQWG---------

610        620        630        640        650
                       ....|....|....|....|....|....|....|....|....|....|
NOV1 GSAC055740_A     CPPTHENVHIRRESESQNRESCDMSLGAINTRNSTLNIPFSSSSSSGDIQ
gi|10435187|          CPPTHENVHIRRESESQNRESCDMSLGAINTRNSTLNIPFSSSSSSGDIQ
gi|14748660|          ----------WEAALAIEKYCRVNGG-----------FSG---------
gi|3127047|           ----------WEAALAIEKYCRVNGG-----------FSG---------
gi|6754620            ----------WEAALAIEKSCRVSGG-----------FSG---------
gi|1083217|           ----------WEAALAIEKSCRVSGG-----------FSG---------

660        670        680        690        700
                       ....|....|....|....|....|....|....|....|....|....|
NOV1 GSAC055740_A     GRNTSPNVSVQKANPMRITESHATKGHMNPPVTTNMHGVARPALPHPSVS
gi|10435187|          GRNTSPNVSVQKANPMRITESHATKGHMNPPVTTNMHGVARPALPHPSVS
gi|14748660|          ------------------------------------------------
gi|3127047|           ------------------------------------------------
gi|6754620            ------------------------------------------------
gi|1083217|           ------------------------------------------------

710        720        730        740        750
                       ....|....|....|....|....|....|....|....|....|....|
NOV1 GSAC055740_A     HGNGDQGPAVRQANSSVPQRSRHPLQDSSGSKIRQPERNRSGNQRQSTVF
gi|10435187|          HGNGDQGPAVRQANSSVPQRSRHPLQDSSGSKIRQPERNRSGNQRQSTVF
gi|14748660|          ---------VKDVYSSTP-------------------THDDVQQSFFL
gi|3127047|           ---------VKDVYSSTP-------------------THDDVQQSFFL
gi|6754620            ---------VKDVYAPTP-------------------VHDDVQQSFFL
gi|1083217|           ---------VKDVYAPTP-------------------VHDDVQQSFSL 760        770        780        790        800
                       ....|....|....|....|....|....|....|....|....|....|
NOV1 GSAC055740_A     DPSLPHLSLSTGGSMITGRQQPATEKRGSIVRFMPDSPQVPNDNSGPDQH
gi|10435187|          DPSLPHLSLSTGGSMITGRQQPATEKRGSIVRFMPDSPQVPNDNSGPDQH
gi|14748660|          AETLKYLYLLFSGDDLLP----------LDHWVFNTEAHPLPVLHLANT
gi|3127047|           AETLKYLYLLFSGDDLLP----------LDHWVFNTEAHPLPVLHLANT
gi|6754620            AETLKYLYLLFSGDDLLP----------LDHWVFNTEAHPLPVLRLANS
gi|1083217|           AETLKYLYLLFSGDDLLP----------LDHWVFNTEAHPLPVLRLANS 810        820        830        840
                       ....|....|....|....|....|....|....|....|....
NOV1 GSAC055740_A     TLSQNFGFSFIPEGGMNPPINANASFIPQVTQPSATRTPAWATEPDSIY
gi|10435187|          TLSQNFGFSFIPEGGMNPPINANASFIP--------------------
gi|14748660|          TLSG---------NPAVR-----------------------------
gi|3127047|           TLSG---------NPAVR-----------------------------
gi|6754620            TLSG---------NPAVR-----------------------------
gi|1083217|           TLSG---------NPAVR-----------------------------
```

The presence of identifiable domains in NOV1, as well as all other NOVX proteins, was determined by searches using software algorithms such as PROSITE, DOMAIN, Blocks, Pfam, ProDomain, and Prints, and then determining the Interpro number by crossing the domain match (or numbers) using the Interpro website (http:www.ebi.ac.uk/interpro). DOMAIN results for NOV1 as disclosed in Tables 1F, were collected from the Conserved Domain Database (CDD) with Reverse Position Specific BLAST analyses. This BLAST analysis software samples domains found in the Smart and Pfam collections.

The NOV1 protein contains the following protein domains (as defined by lnterpro) at the indicated nucleotide positions: domain name Glyco_hydro_47 (InterPro) Glycosyl hydrolase domain (IPR001382) at amino acid positions 69 to 444, domain name. This indicates that the sequence of the invention has properties similar to those of other proteins known to contain this/these domain(s) and similar to the properties of these domains.

Table 1F lists the domain description from DOMAIN analysis results against NOV1. This indicates that the NOV1 sequence has properties similar to those of other proteins known to contain these domains. In a sequence alignment herein, fully conserved single residues are calculated to determine percent homology, and conserved and "strong" semi-conserved residues are calculated to determine percent positives. The "strong" group of conserved amino acid residues may be any one of the following groups of amino acids: STA, NEQK, NHQK, NDEQ, QHRK, MILV, MILF, HY, FYW.

TABLE 1F

Domain Analysis of NOV1

| PSSMs producing significant alignments: | Score (bits) | Evalue |
|---|---|---|
| gnl\|Pfam\|pfam01532 Glyco_hydro_47, Glycosyl hydrolase family 47. | 379 | 4e–106 | gnl\|Pfam\|pfam01532, Glyco_hydro_47, Glycosyl hydrolase family 47. Members of this family are alpha-mannosidases that catalyse the hydrolysis of the terminal 1,2-linked alpha-D-mannose residues in the oligo-mannose oligosaccharide Man (9) (GlcNAc) (2). CD-Length = 444 residues, only 74.8% aligned The disclosed NOV1 nucleic acid encoding a Processing Alpha-1,2-Mannosidase-like protein includes the nucleic acid whose sequence is provided in Table 1A, or a fragment thereof. The invention also includes a mutant or variant nucleic acid any of whose bases may be changed from the corresponding base shown in Table 1A while still encoding a protein that maintains its Processing Alpha-1,2-Mannosidase-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 1% of the bases may be so changed.

Variant sequences are also included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, however, in the case that a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern for example, alteration in temporal expression, physiological response regulation, cell type expression regulation, intensity of expression, stability of transcribed message.

The disclosed NOV1 protein of the invention includes the Processing Alpha-1,2-Mannosidase-like protein whose sequence is provided in Table 1B. The invention also includes a mutant or variant protein any of whose residues may be changed from the corresponding residue shown in Table 1B while still encoding a protein that maintains its Processing Alpha-1,2-Mannosidase-like activities and physiological functions, or a functional fragment thereof. In the mutant or variant protein, up to about 1% of the residues may be so changed.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The mannosidase is a glycoprotein based on the presence of protein-linked sugar and specific binding of the enzyme to concanavalin A-Sepharose. Purified mannosidase was optimally active between pH 5.0 and 6.0. The enzyme was inactive with p-nitrophenyl-alpha-D-mannopyranoside and was inhibited by deoxymannojirimycin but not by swainsonine. The enzyme was specifically activated by $Ca^{2+}$, with half-maximal activation occurring at concentrations of 10 microM or less and was inhibited by $Mn^{2+}$, $Co^{2+}$, $Ba^{2+}$, and $Zn^{2+}$. Calcium ions protected the enzyme against inactivation by p-chloromercuribenzoate. Rabbit liver mannosidase hydrolyzed alpha-1,2-mannosyl-mannose linkages in a variety of substrates including methyl-2-O-alpha-D-mannopyranosyl-alpha-D-mannopyranoside (Schutzbach, J. S. (1987) Anal. Biochem. 167, 279–283), ovalbumin glycopeptide IV, and the high mannose chains of thyroglobulin and phytohemagglutinin-P.

Natural killer cells select targets for lysis based on target cell glycoproteins. Compared to controls, K-562 cells treated with kifunensine, an inhibitor of Golgi mannosidase I, accumulate more high mannose-type asparagine-linked oligosaccharide, Man9GlcNAc2, and bind more concanavalin A, an oligomannosyl binding lectin. In addition, natural killer cell lysis of kifunensine-treated cells increases 34% over that of controls. Increased sensitivity to lysis occurs after treatment with other N-glycan processing inhibitors that promote accumulation of high mannose-type glycosides (deoxymannojirimycin and swainsonine). In addition, kifunensine-treated cells form more effector:target conjugates. Monoclonal antibodies to the adhesion molecule LFA-1 and its ligand ICAM-1 reduce lysis of control targets but are less effective in blocking lysis of kifunensine-treated cells. K-562 cells bind anti-ICAM-1 but not anti-LFA-1, and this binding does not change after kifunensine treatment. These data demonstrate conclusively a role for asparagine-linked oligosaccharides in the human natural killer cell:target interaction. The presence of high mannose-type glycans on K-562 cells correlates with increased binding of effectors and a greater susceptibility to lysis. These results support the idea that target cell N-glycosides influence the NK-target interaction mediated by adhesion molecules such as ICAM-1. PMID: 8093244, UI: 93107032. Man I and Man II were detected within secretory granules and at the cell surface of some cell types (enterocytes, pancreatic acinar cells, goblet cells).

The protein similarity information, expression pattern, and map location for the Processing Alpha-1,2-Mannosidase-like protein and nucleic acid disclosed herein suggest that this Processing Alpha-1,2-Mannosidase may have important structural and/or physiological functions characteristic of the Processing Alpha-1,2-Mannosidase family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

As described earlier, NOV 1 shares extensive sequence homologies with Processing Alpha-1,2-Mannosidase family proteins. The structural similarities indicate that NOV1 may function as a member of Processing Alpha-1,2-Mannosidase family proteins. Accordingly, the NOV1 nucleic acids and proteins identified here may be useful in potential therapeutic applications implicated in (but not limited to) various pathologies and disorders as indicated herein. For example, a cDNA encoding the Processing Alpha-1,2-Mannosidase-like protein NOV1 may be useful in gene therapy, and the Processing Alpha-1,2-Mannosidase-like protein NOV1 may be useful when administered to a subject in need thereof.

The NOV1 nucleic acid encoding Processing Alpha-1,2-Mannosidase-like protein, and the Processing Alpha-1,2-Mannosidase-like protein of the invention, or fragments thereof, may further be useful in diagnostic applications, wherein the presence or amount of the nucleic acid or the protein are to be assessed. Additional disease indications and tissue expression for NOV1 and NOV1 variants, if available, are presented in the Examples.

The Processing Alpha-1,2-Mannosidase disclosed in this invention is expressed in at least the following tissues: Adrenal Gland/Suprarenal gland, Bone Marrow, Brain, Coronary Artery, Foreskin, Heart, Kidney, Liver, Lung, Lymphoid tissue, Mammary gland/Breast, Ovary, Placenta, Prostate, Retina, Salivary Glands, Thyroid, Tonsils, Uterus, Whole Organism. This information was derived by determining the tissue sources of the sequences that were included in the invention, including proprietary SeqCalling sources: Adrenal Gland/Suprarenal gland, Bone Marrow, Brain, Coronary Artery, Foreskin, Heart, Kidney, Liver, Lung, Lymphoid tissue, Mammary gland/Breast, Ovary, Placenta, Prostate, Retina, Salivary Glands, Thyroid, Tonsils, Uterus, Whole Organism; and public PublicEST sources: Melanocyte, colon tumor, brain, pancreatic islet, nervous system.

In addition, the sequence is predicted to be expressed in the following tissues because of the expression pattern of (GenBank-ID: gb:GenBank-ID:AF027156|acc:AF027156) a closely related {*Homo sapiens* alpha 1,2-mannosidase IB mRNA, complete cds homolog in species *Homo sapiens*: Adrenal Gland/Suprarenal gland, Bone Marrow, Brain, Coronary Artery, Foreskin, Heart, Kidney, Liver, Lung, Lymphoid tissue, Mammary gland/Breast, Ovary, Placenta, Prostate, Retina, Salivary Glands, Thyroid, Tonsils, Uterus, Whole Organism Based on the tissues in which NOV1 is most highly expressed, specific uses include developing products for the diagnosis or treatment of a variety of diseases and disorders associated therewith. Additional specific expression of NOV1 in normal and diseased tissues are shown in the Examples.

NOV1 nucleic acids and polypeptides are further useful in the generation of antibodies that bind immuno-specifically to the novel NOV1 substances for use in therapeutic or diagnostic methods. These antibodies may be generated according to methods known in the art, using prediction from hydrophobicity charts, as described in the "Anti-NOVX Antibodies" section below. The disclosed NOV1 protein has multiple hydrophilic regions, each of which can be used as an immunogen. In one embodiment, a contemplated NOV1 epitope is from about amino acids 1 to 35. In another embodiment, a NOV1 epitope is from about amino acids 50 to 85. In additional embodiments, NOV1 epitopes are from about amino acids 95 to 125, from about amino acids 175 to 200, from about amino acids 215 to 325, and from about amino acids 335 to 711. These novel proteins can be used in assay systems for functional analysis of various human disorders, which will help in understanding of pathology of the disease and development of new drug targets for various disorders.

NOV2

A disclosed NOV2 nucleic acid (SEQ ID NO:3) of 2692 nucleotides (also referred to as GSAC055740_B) encoding a novel Ion Transporter-like protein is shown in Table 2A. An open reading frame was identified beginning with an ATG initiation codon at nucleotides 41–43 and ending with a TAA codon at nucleotides 2662–2664. Putative untranslated regions are found upstream from the initiation codon and downstream from the termination codon, and are underlined. The start and stop codons are shown in bold letters in Table 2A.

TABLE 2A

NOV2 nucleotide sequence (SEQ ID NO:3).

<u>CAGGGTGGCTCCGCTTTCGAGCCCGGGCGCGGCGCCCACC</u>ATGCGCGGCTGCCTGCGGCTCGCGCTGCTC
TGCGCGCTGCCCTGGCTCCTGCTGGCGGCGTCGCCCGGGCACCCGGCGAAATCCCCCAGGCAGCCCCCGG
CACCGCGCCGCGACCCCTTCGACGCTGCCAGGGGCGCCGATTTCGATCATGTCTACAGCGGGGTGGTGAA
CCTCAGCACCGAGAACATCTACTCTTTCAACTACACCAGCCAGCCCGACCAGGTGACAGCCGTGAGGGTG
TATGTGAACAGTTCCTCTGAGAATCTCAACTACCCGGTCCTTGTTGTGGTTCGCCAGCAGAAAGAGGTGC
TGTCCTGGCAGGTTCCTCTGCTCTTCCAAGGACTATACCAGAGGAGCTACAATTATCAAGAAGTGAGCCG
CACCTTATGTCCCTCAGAAGCAACCAATGAGACGGGACCCTTGCAGCAACTGATATTTGTAGATGTCGCA
TCCATGGCACCCCTGGGTGCTCAGTACAAACTGCTAGTTACCAAGCTGAAGCACTTCCAGCTCCGGACAA
ATGTTGCCTTTCACTTTACTGCCAGCCCCTCTCAACCTCAGTATTTTCTATACAAGTTTCCCAAAGACGT
GGACTCAGTTATCATTAAAGTGGTGTCTGAAATGGCTTATCCATGTTCTGTTGTCTCAGTCCAGAATATC
ATGTGCCCGGTGTATGATCTCGACCACAATGTGGAATTTAATGGTGTCTATCAGTCCATGACCAAGAAAG
CTGCCATCACGCTACAGAAGAAGGATTTTCCAGGCGAGCAGTTCTTCGTGGTATTTGTGATAAAGCCTGA
AGATTATGCCTGTGGAGGATCTTTCTTCATCCAGGAAAAGGAAAACCAGACCTGGAATCTACAGCGAAAA
AAGAACCTTGAAGTGACCATTGTCCCTTCCATTAAAGAATCTGTTTATGTGAAATCCAGTCTTTTCAGTG
TCTTCATCTTCCTGTCCTTCTACTTGGGATGCCTTCTTGTTGGGTTTGTTCATTATCTGAGGTTTCAGAG
AAAATCCATTGATGGAAGCTTTGGGTCCAATGATGGCTCTGGAAATATGGTGGCATCTCATCCCATTGCT
GCCAGCACACCCGAAGGGAGCAATTATGGGACAATAGATGAGTCAAGCTCCAGTCCTGGAAGGCAGATGT
CCTCCTCCGATGGTGGGGATGGCTCTGGAAATATGGTGGCATCTCATCCCATTGCTGCCAGCACACCCGA
AGGGAGCAATTATGGGACAATAGATGAGTCAAGCTCCAGTCCTGGAAGGCAGATGTCCTCCTCCGATGGT
GGGCCACCGGGCCAGTCAGACACAGACAGCTCCGTGGAGGAGAGCGACTTCGACACCATGCCAGACATTG
AGAGTGATAAAAACATCATCCGGACCAAGATGTTCCTTTACCTGTCAGATTTGTCCAGGAAGGACCGGAG
AATTGTCAGCAAAAAATATAAAATTTATTTTTGGAACATCATCACCATTGCTGTGTTTTACGCGCTGCCC
GTGATCCAGCTGGTCATTACCTATCAGACAGTGGTAAATGTCACTGGCAACCAGGACATCTGTTACTACA
ACTTCCTCTGTGCTCACCCCTTGGGCGTCCTGAGTGCCTTCAACAACATTCTCAGCAATCTGGGCCACGT
GCTTCTGGGCTTCCTCTTCCTGCTGATAGTCTTGCGCCGCGACATCCTCCATCGGAGAGCCCTGGAAGCC
AAGGACATCTTTGCTGTGGAGTACGGGATTCCCAAACACTTTGGTCTCTTCTACGCTATGGGCATTGCAT
TGATGATGGAAGGGGTGCTCAGTGCTTGCTACCATGTCTGCCCTAATTATTCCAACTTCCGATTCGACAC
CTCCTTCATGTACATGATCGCTGGCCTGTGCATGCTGAAGCTCTATCAGACCCGCCACCCAGACATCAAT
GCCAGCGCCTACTCTGCCTATGCCTCCTTTGCTGTGGTCATCATGGTCACCGTCCTTGGAGTGGTGTTTG
GAAAAAATGACGTATGGTTCTGGGTCATCTTCTCTGCAATCCACGTTCTGGCCTCGCTAGCCCTCAGCAC
CCAGATATATTATATGGGTCGTTTCAAGATAGATTTGGGAATTTTCCGGCGGGCTGCCATGGTGTTCTAC
ACAGACTGTATCCAGCAGTGTAGCCGACCTCTATATATGGATAGAATGGTGTTGCTGGTTGTGGGGAATC
TGGTTAACTGGTCCTTCGCCCTCTTTGGATTGATATACCGCCCCAGGGACTTTGCTTCCTACATGCTGGG
CATCTTCATCTGTAACCTTTTGCTGTACCTGGCCTTTTACATCATCATGAAGCTCCGCAGCTCTGAAAAG
GTCCTCCCAGTCCCGCTCTTCTGCATCGTGGCCACCGCTGTGATGTGGGCTGCCGCCCTATATTTTTCT
TCCAGAATCTCAGCAGCTGGGAGGGAACTCCGGCCGAATCCCGGGAGAAGAACCGCGAGTGCATTCTGCT
GGATTTCTTCGATGACCATGACATCTGGCACTTCCTCTCTGCTACTGCTCTGTTTTTCTCATTCTTGGTT
TTGTTAACTTTGGATGATGACCTTGATGTGGTTCGGAGAGACCAGATCCCTGTCTTCTGAACCTCCAACA
TTAA<u>GAGAGGGGAGGGAGCGATCAATCTTGGT</u>

A disclosed NOV2 polypeptide (SEQ ID NO:4) encoded by SEQ ID NO:3 has 869 amino acid residues and is presented in Table 2B using the one-letter amino acid code. NOV2 is likely a Type IIIa membrane protein (clv). SignalP, Psort and/or Hydropathy results predict that NOV2 has a signal peptide and is likely to be localized plasma membrane with a certainty of 0.6400. In an alternative embodiment, NOV2 is likely to be localized to the Golgi body with a certainty of 0.4600, or to the endoplasmic reticulum (membrane) with a certainty of 0.3700, or to the endoplasmic reticulum (lumen) with a certainty of 0.1000. The most likely cleavage site for a NOV2 peptide is between amino acids 19 and 20, i.e., at the dash between amino acids LLA-AS. NOV2 has a molecular weight of 97929.75 Daltons.

silico prediction of the full length and/or part of the DNA sequence of the invention from public human sequence databases. Genomic clone(s) NOV2 GSAC055740$_{13}$ B on chromosome 3 was/were identified by TBLASTN using proprietary sequence file for members of Ion Transporter and/or Ion Transporter family, run against the genomic daily files made available by GenBank or obtained from Human Genome Project Sequencing centers, and processed as described for NOV1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database

TABLE 2B

Encoded NOV2 protein sequence (SEQ ID NO:4).

MRGCLRLALLCALPWLLLAASPGHPAKSPRQPPAPRRDPFDAARGADFDHVYSGVVNLSTENIYSFNYTS

QPDQVTAVRVYVNSSSENLNYPVLVVVRQQKEVLSWQVPLLFQGLYQRSYNYQEVSRTLCPSEATNETGP

LQQLIFVDVASMAPLGAQYKLLVTKLKHFQLRTNVAFHFTASPSQPQYFLYKFPKDVDSVIIKVVSEMAY

PCSVVSVQNIMCPVYDLDHNVEFNGVYQSMTKKAAITLQKKDFPGEQFFVVFVIKPEDYACGGSFFIQEK

ENQTWNLQRKKNLEVTIVPSIKESVYVKSSLFSVFIFLSFYLGCLLVGFVHYLRFQRKSIDGSFGSNDGS

GNMVASHPIAASTPEGSNYGTIDESSSSPGRQMSSSDGGDGSGNMVASHPIAASTPEGSNYGTIDESSSS

PGRQMSSSDGGPPGQSDTDSSVEESDFDTMPDIESDKNIIRTKMFLYLSDLSRKDRRIVSKKYKIYFWNI

ITIAVFYALPVIQLVITYQTVVNVTGNQDICYYNFLCAHPLGVLSAFNNILSNLGHVLLGFLFLLIVLRR

DILHRRALEAKDIFAVEYGIPKHFGLFYAMGIALMMEGVLSACYHVCPNYSNFRFDTSFMYMIAGLCMLK

LYQTRHPDINASAYSAYASFAVVIMVTVLGVVFGKNDVWFWVIFSAIHVLASLALSTQIYYMGRFKIDLG

IFRRAAMVFYTDCIQQCSRPLYMDRMVLLVVGNLVNWSFALFGLIYRPRDFASYMLGIFICNLLLYLAFY

IIMKLRSSEKVLPVPLFCIVATAVMWAAALYFFFQNLSSWEGTPAESREKNRECILLDFFDDHDIWHFLS

ATALFFSFLVLLTLDDDLDVVRRDQIPVF

The sequence of the invention was derived by laboratory cloning of cDNA fragments covering the full length and/or part of the DNA sequence of the invention, and/or by in silico that contains sequences published in patents and patent publications. Patp results include those listed in Table 2C.

TABLE 2C

Patp BLASTP Analysis for NOV2

| Sequences producing High-scoring Segment Pairs | Protein/Organism | Length (aa) | Identity (%) | Positive (%) | E Value |
| --- | --- | --- | --- | --- | --- |
| patp: AAB42358 | Human ORFX ORF2122 polypeptide sequence clone no: 4244 - *Homo sapiens* | 849 | 467/808 (57%) | 593/808 (73%) | 1.3e−247 |
| patp: AAW57901 | Protein of clone CT748_2 - *Homo sapiens* | 479 | 430/444 (96%) | 433/444 (97%) | 1.8e−229 |
| patp: AAB08443 | Amino acid sequence of secreted protein clone CT748_2 - *Homo sapiens* | 479 | 430/444 (96%) | 433/444 (97%) | 1.8e−229 |
| patp: AAB90718 | Human AT748_2 protein sequence - *Homo sapiens* | 479 | 430/444 (96%) | 433/444 (97%) | 1.8e−229 |
| patp: AAB33471 | Human PRO1325 protein UNQ685 clone no: 277 - *Homo sapiens* | 832 | 341/490 (69%) | 403/490 (82%) | 4.0e−184 |

In a search of sequence databases, it was found, for example, that the nucleic acid sequence of this invention has 1693 of 2546 bases (66%) identical to a gb:GenBank-ID:AF151799| acc:AF151799 mRNA from *Homo sapiens* (*Homo sapiens* CGI-40 protein mRNA, complete cds). The full amino acid sequence of the protein of the invention was found to have 467 of 807 amino acid residues (57%) identical to, and 595 of 807 amino acid residues (73%) similar to, the 845 amino acid residue ptnr:SptrEmbl-ACC:Q9Y357 protein from *Homo sapiens* (Human) (CGI-40 protein).

In a further search of public sequence databases, NOV2 was found to have homology to the amino acid sequences shown in the BLASTP data listed in Table 2D.

TABLE 2D

BLASTP results for NOV2

| Gene Index/ Identifier | Protein/Organism | Length (aa) | Identity (%) | Positives (%) | Expect |
|---|---|---|---|---|---|
| gi\|8923171\| ref\|NP_060169.1\| NM_017699 | hypothetical protein FLJ20174 [*Homo sapiens*] | 827 | 827/869 (95%) | 827/869 (95%) | 0.0 |
| gi\|14732097\| ref\|XP_003099.3\| XM_003099 | hypothetical protein FLJ20174 [*Homo sapiens*] | 512 | 492/534 (92%) | 492/534 (92%) | 0.0 |
| gi\|7705757\| ref\|NP_057080.1\| NM_015996 | CGI-40 protein [*Homo sapiens*] | 845 | 464/812 (57%) | 591/812 (72%) | 0.0 |
| gi\|16183698\| ref\|XP_006433.4\| XM_006433 | CGI-40 protein [*Homo sapiens*] | 456 | 310/414 (74%) | 363/414 (86%) | e-180 |
| gi\|13905162\| gb\|AAH06873.1\| AAH06873 BC006873 | Similar to hypothetical protein FLJ20174 [*Mus Musculus*] | 392 | 297/392 (75%) | 343/392 (86%) | e-161 |

The homology of these and other sequences is shown graphically in the ClustalW analysis shown in Table 2E. The NOV2 polypeptide is provided in lane 1.

TABLE 2E

ClustalW Analysis of NOV2

1) Novel NOV2 (SEQ ID NO:4)
2) gi|8923171 (SEQ ID NO:58)
3) gi|14732097 (SEQ ID NO:59)
4) gi|7705757 (SEQ ID NO:60)
5) gi|16183698 (SEQ ID NO:61)
6) gi|13905162 (SEQ ID NO:62)

```
                              10        20        30        40        50
                     ....|....|....|....|....|....|....|....|....|....|
NOV2 GSAC055740_B    --------------------------------------------------
gi|8923171|          --------------------------------------------------
gi|14732097|         --------------------------------------------------
gi|7705757|          MFALGLPFLVLLVASVESHLGVLGPKNVSQKDAEFERTYVDEVNSELVNI
gi|16183698|         --------------------------------------------------
gi|13905162|         --------------------------------------------------

60        70        80        90       100
                     ....|....|....|....|....|....|....|....|....|....|
NOV2 GSAC055740_B    --------------------------------------------------
gi|8923171|          --------------------------------------------------
gi|14732097|         --------------------------------------------------
gi|7705757|          YTFNHTVTRNRTEGVRVSVNVLNKQKGAPLLFVVRQKEAVVSFQVPLILR
gi|16183698|         --------------------------------------------------
gi|13905162|         --------------------------------------------------

110       120       130       140       150
                     ....|....|....|....|....|....|....|....|....|....|
NOV2 GSAC055740_B    --------------------------------------------------
gi|8923171|          --------------------------------------------------
gi|14732097|         --------------------------------------------------
gi|7705757|          GMFQRKYLYQKVERTLCQPPTKNESEIQFFYVDVSTLSPVNTTYQLRVSR
gi|16183698|         --------------------------------------------------
gi|13905162|         --------------------------------------------------
```

TABLE 2E-continued

ClustalW Analysis of NOV2

```
                        160        170        180        190        200
                    ....|....|....|....|....|....|....|....|....|....|
NOV2 GSAC055740_B   --------------------------------------------------
gi|8923171|         --------------------------------------------------
gi|14732097|        --------------------------------------------------
gi|7705757|         MDDFVLRTGEQFSFNTTAAQPQYFKYEFPEGVDSVIVKVTSNKAFPCSVI
gi|16183698|        --------------------------------------------------
gi|13905162|        --------------------------------------------------

210        220        230        240        250
                    ....|....|....|....|....|....|....|....|....|....|
NOV2 GSAC055740_B   --------------------------------------------------
gi|8923171|         --------------------------------------------------
gi|14732097|        --------------------------------------------------
gi|7705757|         SIQDVLCPVYDLDNNVAFIGMYQTMTKKAAITVQRKDFPSNSFYVVVVVK
gi|16183698|        --------------------------------------------------
gi|13905162|        --------------------------------------------------

260        270        280        290        300
                    ....|....|....|....|....|....|....|....|....|....|
NOV2 GSAC055740_B   ---------------------------------------------MRGC
gi|8923171|         ---------------------------------------------MRGC
gi|14732097|        ---------------------------------------------MRGC
gi|7705757|         TEDQACGGSLPFYPFAEDEPVDQGHRQKTLSVLVSQAVTSEAYVSGMLFC
gi|16183698|        --------------------------------------------------
gi|13905162|        --------------------------------------------------

310        320        330        340        350
                    ....|....|....|....|....|....|....|....|....|....|
NOV2 GSAC055740_B   LRLALLCALPWLLLAASPGHPAKSP------------------RQPPAPR
gi|8923171|         LRLALLCALPWLLLAASPGHPAKSP------------------RQPPAPR
gi|14732097|        LRLALLCALPWLLLAASPGHPAKSP------------------RQPPAPR
gi|7705757|         LGIFLSFYLLTVLLACWENWRQKKKTLLVAIDRACPESGHPRVLADSFPG
gi|16183698|        --------------------------------------------------
gi|13905162|        --------------------------------------------------

360        370        380        390        400
                    ....|....|....|....|....|....|....|....|....|....|
NOV2 GSAC055740_B   RDPPDAARGADFDHVYS---GVVNLSTENIYSFNYTS--Q------PDQV
gi|8923171|         RDPPDAARGADFDHVYS---GVVNLSTENIYSFNYTS--Q------PDQV
gi|14732097|        RDPPDAARGADFDHVYS---GVVNLSTENIYSFNYTS--Q------PDQV
gi|7705757|         SSPEGYNYGSFENVSGSTDGLVDSAGTGDLSYGYQGHDQFKRRLPDGQM
gi|16183698|        -------------------------------------------------M
gi|13905162|        --------------------------------------------------

410        420        430        440        450
                    ....|....|....|....|....|....|....|....|....|....|
NOV2 GSAC055740_B   TAVRVYVNSSSENLNYPVLVVVRQQKEVLSWQVPLLFQGLYQRSYNYQEV
gi|8923171|         TAVRVYVNSSSENLNYPVLVVVRQQKEVLSWQVPLLFQGLYQRSYNYQEV
gi|14732097|        TAVRVYVNSSSENLNYPVLVVVRQQKEVLSWQVPLLFQGLYQRSYNYQEV
gi|7705757|         RQLCIAMGRSFEPVGTRPRVDSMSSVEDDYDT---LTDIDSDKNVIRTK
gi|16183698|        RQLCIAMGRSFEPVGTRPRVDSMSSVEDDYDT---LTDIDSDKNVIRTK
gi|13905162|        --------------------------------------------------

460        470        480        490        500
                    ....|....|....|....|....|....|....|....|....|....|
NOV2 GSAC055740_B   SRTLCPSEATNETGPLQQLIFVDVASMAPLGAQYKLLVTKLKH-FQLRTN
gi|8923171|         SRTLCPSEATNETGPLQQLIFVDVASMAPLGAQYKLLVTKLKH-FQLRTN
gi|14732097|        SRTLCPSEATNETGPLQQLIFVDVASMAPLGAQYKLLVTKLKH-FQLRTN
gi|7705757|         QYLYVADLARKDKRVLRKKYQIYFWNIATIAVFYALPVVQLVITYQTVVN
gi|16183698|        QYLYVADLARKDKRVLRKKYQIYFWNIATIAVFYALPVVQLVITYQTVVN
gi|13905162|        ---------------RKKYQIYFWNIATIAVFYALPVVQLVITYQTVVN 510        520        530        540        550
                    ....|....|....|....|....|....|....|....|....|....|
NOV2 GSAC055740_B   VAFHFTASPSQPQYFLYKFPKDVDSVIIKVVSEMAYPCSVVSVQNIMCPV
gi|8923171|         VAFHFTASPSQPQYFLYKFPKDVDSVIIKVVSEMAYPCSVVSVQNIMCPV
gi|14732097|        VAFHFTASPSQPQYFLYKFPKDVDSVIIKVVSEMAYPCSVVSVQNIMCPV
gi|7705757|         VTGNQDICYYN---FLCAHPLGNLSAFNNILSNLGYILLGLLFLLIILQR
gi|16183698|        VTGNQDICYYN---FLCAHPLGNLSAFNNILSNLGYILLGLLFLLIILQR
gi|13905162|        VTGNQDICYYN---FLCAHPLGNLSAFNNILSNLGYILLGLLFLLIILQR 560        570        580        590        600
                    ....|....|....|....|....|....|....|....|....|....|
NOV2 GSAC055740_B   YDLDHM-VEFNGVYQSMTKKAAIPLQKKDFPGEQFFVVFVIKPEDYACGG
gi|8923171|         YDLDHM-VEFNGVYQSMTKKAAIPLQKKDFPGEQFFVVFVIKPEDYACGG
gi|14732097|        YDLDHM-VEFNGVYQSMTKKAAIPLQKKDFPGEQFFVVFVIKPEDYACGG
gi|7705757|         -EINHMRALLRNDLCALECGIPKHFGLFYAMGTALMMEGLLSACYHVCPN
gi|16183698|        -EINHMRALLRNDLCALECGIPKHFGLFYAMGTALMMEGLLSACYHVCPN
gi|13905162|        -EINHMRALLRNDLCALECGIPKHFGLFYAMGTALMMEGLLSACYHVCPN
```

TABLE 2E-continued

ClustalW Analysis of NOV2

```
                         610        620        630        640        650
                    ....|....|....|....|....|....|....|....|....|....|
NOV2 GSAC055740_B   SFFIQEKENQTWNLQ--RKKNLEVTIVPSIKESVYVKSSLFSVFTFLSFY
gi|8923171|         SFFIQEKENQTWNLQ--RKKNLEVTIVPSIKESVYVKSSLFSVFTFLSFY
gi|14732097|        SFFIQEKENQTWNLQ--RKKNLEVTIVPSIKESVYVKSSLFSVFTFLSFY
gi|7705757|         YTNFQFDTSFMYMIAGLCMLKLYQKRHPDINASAYSAYACLAIVIFFSVL
gi|16183698|        YTNFQFDTSFMYMIAGLCMLKLYQKRHPDINASAYSAYACLAIVIFFSVL
gi|13905162|        YTNFQFDTSFMYMIAGLCMLKLYQKRHPDINASAYSAYACLAIVIFFSVL 660        670        680        690        700
                    ....|....|....|....|....|....|....|....|....|....|
NOV2 GSAC055740_B   LGCLLVG-FVHYLRFQRKSIDGSFGSNDGS---GNMVASHPIAASTPEGS
gi|8923171|         LGCLLVG-FVHYLRFQRKSIDGSFGSNDGS---GNMVASHPIAASTPEGS
gi|14732097|        LGCLLVG-FVHYLRFQRKSIDGSFGSNDGS---GNMVASHPIAASTPEGS
gi|7705757|         GVVFGKGNTAFWIVFSIIHIIATLLLSTQLYYMGRWKLDSGIFRRILHVL
gi|16183698|        GVVFGKGNTAFWIVFSIIHIIATLLLSTQLYYMGRWKLDSGIFRRILHVL
gi|13905162|        GVVFGKGNTAFWIVFSIIHIIATLLLSTQLYYMGRWKLDSGIFRRILHVL 710        720        730        740        750
                    ....|....|....|....|....|....|....|....|....|....|
NOV2 GSAC055740_B   NYGTIDESSS--SPGRQMSSSDGGDGSGNMVASHPIAASTPEGSNYGTID
gi|8923171|         NYGTIDESSS--SPGRQMSSSDG-----G---------------------
gi|14732097|        NYGTIDESSS--SPGRQMSSSDG-----G---------------------
gi|7705757|         YTDCIRQCSGPLYVDRMVLLVMG---------------------------
gi|16183698|        YTDCIRQCSGPLYVDRMVLLVMG---------------------------
gi|13905162|        YTDCIRQCSGPLYVDRMVLLVMG---------------------------

760        770        780        790        800
                    ....|....|....|....|....|....|....|....|....|....|
NOV2 GSAC055740_B   ESSSSPGRQMSSSDGGPPGQSDTDSSVEESDFDTMP-DIESDKNIIRT-K
gi|8923171|         -----------------PPGQSDTDSSVEESDFDTMP-DIESDKNIIRT-K
gi|14732097|        -----------------PPGQSDTDSSVEESDFDTMP-DIESDKNIIRT-K
gi|7705757|         -------------------NVINWSLAAYGLIMRPNDFASYLLAIGICN
gi|16183698|        -------------------NVINWSLAAYGLIMRPNDFASYLLAIGICN
gi|13905162|        -------------------NIINWSLAAYGLIMRPNDFASYLLAIGICN 810        820        830        840        850
                    ....|....|....|....|....|....|....|....|....|....|
NOV2 GSAC055740_B   MFLYLSDLSRKDRRIVSKKYKIYFWNITTIAVFYALP---VIQLVITYQT
gi|8923171|         MFLYLSDLSRKDRRIVSKKYKIYFWNITTIAVFYALP---VIQLVITYQT
gi|14732097|        MFLYLSDLSRKDRRIVSKKYKIYFWNITTIAVFYALP---VIQLVITYQT
gi|7705757|         LLLYFAFYIIMKLRSGERIKLIPLLCIVCTSVVWGFALFFFFQGLSTWQK
gi|16183698|        LLLYFAFYIIMKLRSGERIKLIPLLCIVCTSVVWGFALFFFFQGLSTWQK
gi|13905162|        LLLYFAFYIIMKLRSGERIKLIPLLCIVCTSVVWGFALFFFFQGLSTWQK 860        870        880        890        900
                    ....|....|....|....|....|....|....|....|....|....|
NOV2 GSAC055740_B   VVNVIG--NQDICYYNFLCAHPLGVLSAFNNILSNLGHVLLGFLFLLIVL
gi|8923171|         VVNVIG--NQDICYYNFLCAHPLGVLSAFNNILSNLGHVLLGFLFLLIVL
gi|14732097|        VVNVIG--NQDICYYNFLCAHPLGVLRPS---------------------
gi|7705757|         TPAESREHNRDCILLDFFDDHDIWHFLSS---------------------
gi|16183698|        TPAESREHNRDCILLDFFDDHDIWHFLSS---------------------
gi|13905162|        TPAESREHNRDCILLDFFDDHDIWHFLSS---------------------

910        920        930        940        950
                    ....|....|....|....|....|....|....|....|....|....|
NOV2 GSAC055740_B   RRDILHRRALEAKDIFAVEYGIPKHFGLFYAMGIALMMEGVLSACYHVCP
gi|8923171|         RRDILHRRALEAKDIFAVEYGIPKHFGLFYAMGIALMMEGVLSACYHVCP
gi|14732097|        --------------------------------------------------
gi|7705757|         --------------------------------------------------
gi|16183698|        --------------------------------------------------
gi|13905162|        --------------------------------------------------

960        970        980        990        1000
                    ....|....|....|....|....|....|....|....|....|....|
NOV2 GSAC055740_B   NYSNFRFDTSFMYMIAGLCMLKLYQTRHPDINASAYSAYASFAVVIMVTV
gi|8923171|         NYSNFRFDTSFMYMIAGLCMLKLYQTRHPDINASAYSAYASFAVVIMVTV
gi|14732097|        ------------------------TT-FSAIWATCFWASSSC--------
gi|7705757|         ------------------------IAMFGSFLVSGPPGAALRIT------
gi|16183698|        ------------------------IAMFGSFLVSGPPGRAGWVREGSSCL
gi|13905162|        ------------------------IAMFGSFLVLLTLDDDLDTVQRDKIY 1010       1020       1030       1040       1050
                    ....|....|....|....|....|....|....|....|....|....|
NOV2 GSAC055740_B   LGVVFGKNDVWFWVIFSAIHVLASLALSTQIYYMGRFKIDLGIFRRAAMV
gi|8923171|         LGVVFGKNDVWFWVIFSAIHVLASLALSTQIYYMGRFKIDLGIFRRAAMV
gi|14732097|        --------------------------------------------------
gi|7705757|         --------------------------------------------------
gi|16183698|        LPCG----------------------------------------------
gi|13905162|        VF------------------------------------------------
```

TABLE 2E-continued

ClustalW Analysis of NOV2

```
                          1060       1070       1080       1090       1100
                     ....|....|....|....|....|....|....|....|....|....|
NOV2 GSAC055740_B    FYTDCIQQCSRPLYMDRMVLLVVGNLVNWSFALFGLIYRPRDFASYMLGI
gi|8923171|          FYTDCIQQCSRPLYMDRMVLLVVGNLVNWSFALFGLIYRPRDFASYMLGI
gi|14732097|         --------------------------------------------------
gi|7705757|          --------------------------------------------------
gi|16183698|         --------------------------------------------------
gi|13905162|         --------------------------------------------------

1110       1120       1130       1140       1150
                     ....|....|....|....|....|....|....|....|....|....|
NOV2 GSAC055740_B    FICNLLLYLAFYIIMKLRSSEKVLPVPLFCIVATAVMWAAALYFFFQNLS
gi|8923171|          FICNLLLYLAFYIIMKLRSSEKVLPVPLFCIVATAVMWAAALYFFFQNLS
gi|14732097|         --------------------------------------------------
gi|7705757|          --------------------------------------------------
gi|16183698|         --------------------------------------------------
gi|13905162|         --------------------------------------------------

1160       1170       1180       1190       1200
                     ....|....|....|....|....|....|....|....|....|....|
NOV2 GSAC055740_B    SWEGTPAESREKNRECILLDFFDDHDIWHFLSATALFFSFLVLLTLDDDL
gi|8923171|          SWEGTPAESREKNRECILLDFFDDHDIWHFLSATALFFSFLVLLTLDDDL
gi|14732097|         --------------------------------------------------
gi|7705757|          --------------------------------------------------
gi|16183698|         --------------------------------------------------
gi|13905162|         --------------------------------------------------

1210
                     ....|....|.
NOV2 GSAC055740_B    DVVRRDQIPVF
gi|8923171|          DVVRRDQIPVF
gi|14732097|         -----------
gi|7705757|          -----------
gi|16183698|         -----------
gi|13905162|         -----------
```

The ClustalW analyses for NOV1–NOV20 were drawn with the shading value set at 60% homology across all clones analyzed. The ClustalW was redone using the sequences of the first three lanes only, i.e. NOV2 with the two clones showing the highest homology according to the BLASTP analysis of Table 2D. This repeat alignment is shown in Table 2F.

TABLE 2F

ClustalW Analysis of NOV2

1) Novel NOV2 (SEQ ID NO:4)
2) gi|8923171 (SEQ ID NO:58)
3) gi|14732097 (SEQ ID NO:59)

```
                          10         20         30         40         50
                     ....|....|....|....|....|....|....|....|....|....|
NOV2 GSAC055740_B    MRGCLRLALLCALPWLLLAASPGHPAKSPRQPPAPRRDPFDAARGADFDH
gi|8923171|          MRGCLRLALLCALPWLLLAASPGHPAKSPRQPPAPRRDPFDAARGADFDH
gi|14732097|         MRGCLRLALLCALPWLLLAASPGHPAKSPRQPPAPRRDPFDAARGADFDH 60         70         80         90         100
                     ....|....|....|....|....|....|....|....|....|....|
NOV2 GSAC055740_B    VYSGVVNLSTENIYSFNYTSQPDQVTAVRVYVNSSSENLNYPVLVVVRQQ
gi|8923171|          VYSGVVNLSTENIYSFNYTSQPDQVTAVRVYVNSSSENLNYPVLVVVRQQ
gi|14732097|         VYSGVVNLSTENIYSFNYTSQPDQVTAVRVYVNSSSENLNYPVLVVVRQQ 110        120        130        140        150
                     ....|....|....|....|....|....|....|....|....|....|
NOV2 GSAC055740_B    KEVLSWQVPLLFQGLYQRSYNYQEVSRTLCPSEATNETGPLQQLIFVDVA
gi|8923171|          KEVLSWQVPLLFQGLYQRSYNYQEVSRTLCPSEATNETGPLQQLIFVDVA
gi|14732097|         KEVLSWQVPLLFQGLYQRSYNYQEVSRTLCPSEATNETGPLQQLIFVDVA 160        170        180        190        200
                     ....|....|....|....|....|....|....|....|....|....|
NOV2 GSAC055740_B    SMAPLGAQYKLLVTKLKHFQLRTNVAFHFTASPSQPQYFLYKFPKDVDSV
gi|8923171|          SMAPLGAQYKLLVTKLKHFQLRTNVAFHFTASPSQPQYFLYKFPKDVDSV
gi|14732097|         SMAPLGAQYKLLVTKLKHFQLRTNVAFHFTASPSQPQYFLYKFPKDVDSV
```

TABLE 2F-continued

ClustalW Analysis of NOV2

```
                        210        220        230        240        250
                        ....|....|....|....|....|....|....|....|....|....|
NOV2 GSAC055740_B       IIKVVSEMAYPCSVVSVQNIMCPVYDLDHNVEFNGVYQSMYKKAAITLQK
gi|8923171|             IIKVVSEMAYPCSVVSVQNIMCPVYDLDHNVEFNGVYQSMYKKAAITLQK
gi|14732097|            IIKVVSEMAYPCSVVSVQNIMCPVYDLDHNVEFNGVYQSMYKKAAITLQK 260        270        280        290        300
                        ....|....|....|....|....|....|....|....|....|....|
NOV2 GSAC055740_B       KDFPGEQFFVVFVIKPEDYACGGSFFIQEKENQTWNLQRKKNLEVTIVPS
gi|8923171|             KDFPGEQFFVVFVIKPEDYACGGSFFIQEKENQTWNLQRKKNLEVTIVPS
gi|14732097|            KDFPGEQFFVVFVIKPEDYACGGSFFIQEKENQTWNLQRKKNLEVTIVPS 310        320        330        340        350
                        ....|....|....|....|....|....|....|....|....|....|
NOV2 GSAC055740_B       IKESVYVKSSLFSVFIFLSFYLGCLLVGFVHYLRFQRKSIDGSFGSNDGS
gi|8923171|             IKESVYVKSSLFSVFIFLSFYLGCLLVGFVHYLRFQRKSIDGSFGSNDGS
gi|14732097|            IKESVYVKSSLFSVFIFLSFYLGCLLVGFVHYLRFQRKSIDGSFGSNDGS 360        370        380        390        400
                        ....|....|....|....|....|....|....|....|....|....|
NOV2 GSAC055740_B       GNMVASHPIAASTPEGSNYGTIDESSSSPGRQMSSSDGGDGSGNMVASHP
gi|8923171|             GNMVASHPIAASTPEGSNYGTIDESSSSPGRQMSSSDG----G-------
gi|14732097|            GNMVASHPIAASTPEGSNYGTIDESSSSPGRQMSSSDG----G-------

410        420        430        440        450
                        ....|....|....|....|....|....|....|....|....|....|
NOV2 GSAC055740_B       IAASTPEGSNYGTIDESSSSPGRQMSSSDGGPPGQSDTDSSVEESDFDTM
gi|8923171|             ------------------------------PPGQSDTDSSVEESDFDTM
gi|14732097|            ------------------------------PPGQSDTDSSVEESDFDTM 460        470        480        490        500
                        ....|....|....|....|....|....|....|....|....|....|
NOV2 GSAC055740_B       PDIESDKNIIRTKMFLYLSDLSRKDRRIVSKKYKIYFWNIITIAVFYALP
gi|8923171|             PDIESDKNIIRTKMFLYLSDLSRKDRRIVSKKYKIYFWNIITIAVFYALP
gi|14732097|            PDIESDKNIIRTKMFLYLSDLSRKDRRIVSKKYKIYFWNIITIAVFYALP 510        520        530        540        550
                        ....|....|....|....|....|....|....|....|....|....|
NOV2 GSAC055740_B       VIQLVITYQTVVNVTGNQDICYYNFLCAHPLGVLSAFNNILSNLGHVLLG
gi|8923171|             VIQLVITYQTVVNVTGNQDICYYNFLCAHPLGVLSAFNNILSNLGHVLLG
gi|14732097|            VIQLVITYQTVVNVTGNQDICYYNFLCAHPLGVLRPS-------------

560        570        580        590        600
                        ....|....|....|....|....|....|....|....|....|....|
NOV2 GSAC055740_B       FLFLLIVLRRDILHRRALEAKDIFAVEYGIPKHFGLFYAMGIALMMEGVL
gi|8923171|             FLFLLIVLRRDILHRRALEAKDIFAVEYGIPKHFGLFYAMGIALMMEGVL
gi|14732097|            --------------------------------------------------

610        620        630        640        650
                        ....|....|....|....|....|....|....|....|....|....|
NOV2 GSAC055740_B       SACYHVCPNYSNFRFDTSFMYMIAGLVMLKLYQTRHPDINASAYSAYASF
gi|8923171|             SACYHVCPNYSNFRFDTSFMYMIAGLVMLKLYQTRHPDINASAYSAYASF
gi|14732097|            ---------------TT-FSATWAICFWASSSC 660        670        680        690        700
                        ....|....|....|....|....|....|....|....|....|....|
NOV2 GSAC055740_B       AVVIMVTVLGVVFGKNDVWFWVIFSAIHVLASLALSTQIYYMGRFKIDLG
gi|8923171|             AVVIMVTVLGVVFGKNDVWFWVIFSAIHVLASLALSTQIYYMGRFKIDLG
gi|14732097|            --------------------------------------------------

710        720        730        740        750
                        ....|....|....|....|....|....|....|....|....|....|
NOV2 GSAC055740_B       IFRRAAMVFYTDCIQQCSRPLYMDRMVLLVVGNLVNWSFALFGLIYRPRD
gi|8923171|             IFRRAAMVFYTDCIQQCSRPLYMDRMVLLVVGNLVNWSFALFGLIYRPRD
gi|14732097|            --------------------------------------------------

760        770        780        790        800
                        ....|....|....|....|....|....|....|....|....|....|
NOV2 GSAC055740_B       FASYMLGIFICNLLLYLAFYIIMKLRSSEKVLPVPLFCIVATAVMWAAAL
gi|8923171|             FASYMLGIFICNLLLYLAFYIIMKLRSSEKVLPVPLFCIVATAVMWAAAL
gi|14732097|            --------------------------------------------------

810        820        830        840        850
                        ....|....|....|....|....|....|....|....|....|....|
NOV2 GSAC055740_B       YFFFQNLSSWEGTPAESREKNRECILLDFFDDHIWHFLSATALFFSFLV
gi|8923171|             YFFFQNLSSWEGTPAESREKNRECILLDFFDDHIWHFLSATALFFSFLV
gi|14732097|            --------------------------------------------------
```

TABLE 2F-continued

ClustalW Analysis of NOV2

```
                         860
                ....|....|....|....
NOV2 GSAC055740_B  LLTLDDDLDVVRRDQIPVF
gi|8923171|        LLTLDDDLDVVRRDQIPVF
gi|14732097|       -------------------
```

The NOV2 protein contains the following protein domains (as defined by Interpro) at the indicated nucleotide positions: domain name Ion transport protein domain (IPR000636) at amino acid positions 441 to 662. This indicates that the sequence of the invention has properties similar to those of other proteins known to contain this/these domain(s) and similar to the properties of these domains. No other known domains were found for NOV2 using DOMAIN software analyses.

The disclosed NOV2 nucleic acid encoding a Ion Transporter-like protein includes the nucleic acid whose sequence is provided in Table 2A, or variant thereof, including a SNP, fragment, homology, analog of the sequence is provided in Table 2A. The invention also includes a mutant or variant nucleic acid any of whose bases may be changed from the corresponding base shown in Table 2A while still encoding a protein that maintains its Ion Transporter-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 34% percent of the bases may be so changed.

The disclosed NOV2 protein of the invention includes the Ion Transporter-like protein whose sequence is provided in Table 2B. The invention also includes a mutant or variant protein any of whose residues may be changed from the corresponding residue shown in Table 2B while still encoding a protein that maintains its Ion Transporter-like activities and physiological functions, or a functional fragment thereof. In the mutant or variant protein, up to about 43% percent of the residues may be so changed.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The protein similarity information, expression pattern, and map location for the Ion Transporter-like protein and nucleic acid disclosed herein suggest that this Ion Transporter may have important structural and/or physiological functions characteristic of the Ion Transporter family.

Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoictic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

The structural similarities indicate that NOV2 may function as a member of Ion Transporter family proteins. Accordingly, the NOV2 nucleic acids and proteins identified here may be useful in potential therapeutic applications implicated in (but not limited to) various pathologies and disorders as indicated herein. For example, a CDNA encoding the Ion Transporter-like protein NOV2 may be useful in gene therapy, and the Ion Transporter-like protein NOV2 may be useful when administered to a subject in need thereof. The NOV2 nucleic acid encoding Ion Transporter-like protein, and the Ion Transporter-like protein of the invention, or fragments thereof, may further be useful in diagnostic applications, wherein the presence or amount of the nucleic acid or the protein are to be assessed. Additional disease indications and tissue expression for NOV2 and NOV2 variants, if available, are presented in the Examples.

Amygdala, Spleen, Tonsils, Uterus, Whole Organism; SeqCalling_celltypes: brain olfactory kidney Pancreas tumor B cells breast. This information was derived by determining the tissue sources of the sequences that were included in the invention. SeqCalling sources: Amygdala, Spleen, Tonsils, Uterus, Whole Organism PublicEST sources: brain olfactory kidney Pancreas tumor B cells breast. In addition, the sequence is predicted to be expressed in the following tissues because of the expression pattern of (GenBank-ID: gb:GenBank-ID:AF151799| acc:AF151799) a closely related {Homo sapiens CGI-40 protein mRNA, complete cds homolog in species Homo sapiens: Amygdala, Spleen, Tonsils, Uterus, Whole Organism.

Based on the tissues in which NOV2 is most highly expressed, specific uses include developing products for the diagnosis or treatment of a variety of diseases and disorders associated therewith. Further specific expression of NOV2 in normal and diseased tissues are shown in the Examples.

NOV2 nucleic acids and polypeptides are further useful in the generation of antibodies that bind immuno-specifically to the novel NOV2 substances for use in therapeutic or diagnostic methods. These antibodies may be generated according to methods known in the art, using prediction from hydrophobicity charts, as described in the "Anti-NOVX Antibodies" section below. The disclosed NOV2 protein has multiple hydrophilic regions, each of which can be used as an immunogen. In one embodiment, a contemplated NOV2 epitope is from about amino acids 1 to 20. In another embodiment, a NOV2 epitope is from about amino acids 25 to 90. In additional embodiments, NOV2 epitopes are from about amino acids 110 to 145, from about amino acids 155 to 200, from about amino acids 225 to 265, from about amino acids 275 to 305, from about amino acids 335 to 485, from about amino acids 555 to 575, from about amino acids 600 to 620, from about amino acids 635 to 655, from about amino acids 685 to 720, from about amino acids 795 to 835, and from about amino acids 860 to 869. These novel proteins can be used in assay systems for functional analysis of various human disorders, which will help in understanding of pathology of the disease and development of new drug targets for various disorders.

NOV3

A disclosed NOV3 nucleic acid (SEQ ID NO:5) of 716 nucleotides (also referred to as GSAC068993_A) encoding a novel Ras-related protein-like protein is shown in Table 3A. An open reading frame was identified beginning with an ATG initiation codon at nucleotides 41–43 and ending with a TAA codon at nucleotides 659–661. Putative untranslated regions are found upstream from the initiation codon and downstream from the termination codon, and are underlined. The start and stop codons are shown in bold letters in Table 3A.

TABLE 3A

NOV3 nucleotide sequence (SEQ ID NO:5).

CAGATTCTTCCTAACCTGTTGGTGAGAACTACAACACAAGATGGCCGCAAATAAGCCCAAGGGTCAGAAT

AATTTGGCCTTACACAAAGTCATCACGGTGGGCAGTGCCGGTGTGGGCAAGGCAGCTCTGACTCTACAGT

TCATGTACGATCAATTTCTTAAACCTTATGAACCATCTAAAGAAGGCACCTATCGGAAGAGAGTAGTACT

GGATGGCGAGGAAGTACAGATCGGTATCTTAGAAACAGCTGGGCAGGAGGACTATGCTGCAATTAGGGAC

AACTATTTCCGAAGCAGAGAGGGGTTTCTCTGTGTCTTCTCTATTACAGAAATGGAATCCTTTGCAGCTA

CAGCTGACTTCAGGGAGCAGATTTTAAGAGTAAAAGAAGATGAGAATGTTCCATTTCTACTGGTTGGTAA

CAAATCAGATTTAGAAGATAAAAGGCCGGTTTCTGTAAAAGAGGCAAAAAACAGAGCTGACCAGTGGAAT

GTTAACTATGTGGAAACATCTGCTAAAACACAGGCTAATGTTGACAAGGTACTTTTTGATTTAATGAGAG

AAATTCGAGCAAAAAAGATGGAAGACAGCAAAGAAAAGAATGGAAAAAAGAAGAGGAAAAGTTCAGCCAA

GAGAATCAGAGAAAGGTGCTGCATTTTATAATCAAAGTCCAAATTCCTTTCTTATCTTGACCATACTAAT

AAATATAATTTATAAG

A disclosed NOV3 polypeptide (SEQ ID NO:6) encoded by SEQ ID NO:5 has 206 amino acid residues and is presented in Table 3B using the one-letter amino acid code. SignalP, Psort and/or Hydropathy results predict that NOV3 has a no known signal peptide and is likely to be localized nucleus with a certainty of 0.9700. In an alternative embodiment, NOV3 is likely to be localized to the mitochondrial matrix space with a certainty of 0.1000, or to the lysosome (lumen) with a certainty of 0.1000, or to the endoplasmic reticulum (membrane) with an unclear certainty (0.0000). NOV3 has a molecular weight of 23475.69 Daltons.

TABLE 3B

Encoded NOV3 protein sequence (SEQ ID NO:6).

MAANKPKGQNNLALHKVITVGSAGVGKAALTLQFMYDQFLKPYEPSKEGTYRKRVVLDGEEVQIGILETA

GQEDYAAIRDNYFRSREGFLCVFSITEMESFAATADFREQILRVKEDENVPFLLVGNKSDLEDKRPVSVK

EAKNRADQWNVNYVETSAKTQANVDKVLFDLMREIRAKKMEDSKEKNGKKKRKSSAKRIRERCCIL

Genomic clones NOV3 GSAC068993_A on chromosome 12 were identified by TBLASTN using proprietary sequence file for members of Ras-Related protein and/or Ras-Related protein family, run against the genomic daily files made available by GenBank or obtained from Human Genome Project Sequencing centers, and further analyzed as described for NOV 1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database that contains sequences published in patents and patent publications. Patp results include those listed in Table 3C.

In a search of sequence databases, it was found, for example, that the nucleic acid sequence of this invention has 626 of 714 bases (87%) identical to a gb:GenBank-ID:RATRALA| acc:L19698 mRNA from *Rattus norvegicus* (Rat GTP-binding protein (ral A) mRNA, complete cds). The full amino acid sequence of the protein of the invention was found to have 184 of 206 amino acid residues (89%) identical to, and 196 of 206 amino acid residues (95%) similar to, the 206 amino acid residue ptnr:SWISSPROT-ACC:P05810 protein from *Mus musculus* (Mouse), *Rattus norvegicus* (Rat), and (Ras-Related protein RAL-A).

In a further search of public sequence databases, NOV3 was found to have homology to the amino acid sequences shown in the BLASTP data listed in Table 3D.

TABLE 3C

Patp BLASTP Analysis for NOV3

| Sequences producing High-scoring Segment Pairs | Protein/Organism | Length (aa) | Identity (%) | Positives (%) | E Value |
|---|---|---|---|---|---|
| patp: AAW04473 | Human K-ras B protein isoform - *Homo sapiens* | 188 | 90/192 (46%) | 134/192 (69%) | 1.9e−42 |
| patp: AAW26602 | Human K-ras encoded polypeptide - *Homo sapiens* | 189 | 85/192 (44%) | 132/192 (68%) | 6.7e−40 |
| patp: AAW04472 | Human K-ras B protein isoform - *Homo sapiens* | 189 | 84/192 (43%) | 132/192 (68%) | 2.3e−39 |
| patp: AAR95675 | K-ras oncoprotein - *Homo sapiens* | 228 | 84/192 (43%) | 131/192 (68%) | 3.7e−39 |
| patp: AAB99360 | Human H-Ras, c-Raf1 and aequorea EYFP and ECFP protein construct - *Homo sapiens* | 740 | 83/181 (45%) | 123/181 (67%) | 4.2e−39 |

TABLE 3D

BLASTP results for NOV3

| Gene Index/ Identifier | Protein/Organism | Length (aa) | Identity (%) | Positives (%) | Expect |
|---|---|---|---|---|---|
| gi|9507025| ref|NP_062364.1| NM_019491 | v-ral simian leukemia viral oncogene homolog A (ras related); ral-A protein [*Mus musculus*] | 206 | 184/206 (89%) | 195/206 (95%) | 3e−83 |
| gi|14740792| ref|XP_035787.1| XM_035787 | v-ral simian leukemia viral oncogene homolog A (ras related) [*Homo sapiens*] | 206 | 183/206 (89%) | 195/206 (95%) | 1e−82 |
| gi|12851417| dbj|BAB29033.1| AK013881 | putative [*Mus musculus*] | 206 | 156/177 (88%) | 167/177 (94%) | 6e−82 |
| gi|4885569| ref|NP_005393.1| NM_005402 | v-ral simian leukemia viral oncogene homolog A (ras related); ras-like protein; RAS-like protein A; Simian leukemia viral (v-ral) oncogene homolog [*Homo sapiens*] | 209 | 181/204 (89%) | 193/204 (95%) | 9e−82 |
| gi|9247092| gb|AAF86279.1| AF278539_1 | Ras related small G protein RAL-A [*Xenopus laevis*] | 206 | 181/206 (88%) | 193/206 (94%) | 3e−81 |

The homology of these and other sequences is shown graphically in the ClustalW analysis shown in Table 3E. The NOV3 polypeptide is provided in lane 1.

domain at amino acid positions 2 to 170, domain name ras domain at amino acid positions 16 to 198, etc. Table 3F lists the domain description from DOMAIN analysis results

TABLE 3E

ClustalW Analysis of NOV3

1) Novel NOV3 (SEQ ID NO:6)
2) gi|10435187 (SEQ ID NO:63)
3) gi|14748660 (SEQ ID NO:64)
4) gi|3127047 (SEQ ID NO:65)
5) gi|6754620 (SEQ ID NO:66)
6) gi|1083217 (SEQ ID NO:67)

```
                          10        20        30        40        50
                    ....|....|....|....|....|....|....|....|....|....|
NOV3 GSAC068993_A   ---MAANKPKGQNNLALHKVITVGSAGVGKAALTLQFMYDQFLKPYEESK
gi|9507025|         ---MAANKPKGQNSLALHKVIMVGSGGVGKSALTLQFMYDEFVEDYEPTK
gi|14740792|        ---MAANKPKGQNSLALHKVIMVGSGGVGKSALTLQFMYDEFVEDYEPTK
gi|12851417|        ---MAANKPKGQNSLALHKVIMVGSGGVGKSALTLQFMYDEFVEDYEPTK
gi|4885569|         MVDYLANKPKGQNSLALHKVIMVGSGGVGKSALTLQFMYDEFVEDYEPTK
gi|9247092|         ---MAANKPKGQNSLALHKVIMVGSGGVGKSALTLQFMYDEFVEDYEPTK 60        70        80        90       100
                    ....|....|....|....|....|....|....|....|....|....|
NOV3 GSAC068993_A   EGTYRKRVVLDGEEVQIGILETAGQEDYAAIRDNYFRSREGFLCVFSITE
gi|9507025|         ADSYRKKVVLDGEEVQIDILDTAGQEDYAAIRDNYFRSGEGFLCVFSITE
gi|14740792|        ADSYRKKVVLDGEEVQIDILDTAGQEDYAAIRDNYFRSGEGFLCVFSITE
gi|12851417|        ADSYRKKVVPDGEEVQIDILDTAGQEDYAAIRDNYFRSGEGFLCVFSITE
gi|4885569|         ADSYRKKVVLDGEEVQIDILDTAGQEDYAAIRDNYFRSGEGFLCVFSITE
gi|9247092|         ADSYRKKVVLDGVEVQIDILDTAGQEDYAAIRDNYFRSGEGFLCVFSITE 110       120       130       140       150
                    ....|....|....|....|....|....|....|....|....|....|
NOV3 GSAC068993_A   MESFAATADFREQILRVKEDENVPFLLVGNKSDLEDKRPVSVKEAKNRAD
gi|9507025|         MESFAATADFREQILRVKEDENVPFLLVGNKSDLEDKRQVSVEEAKNRAD
gi|14740792|        MESFAATADFREQILRVKEDENVPFLLVGNKSDLEDKRQVSVEEAKNRAD
gi|12851417|        MESFAATADFREQILRVKEDENVPFLLVGNKSDLEDKRQVSVEEAKNRAD
gi|4885569|         MESFAATADFREQILRVKEDENVPFLLVGNKSDLEDKRQVSVEEAKNRAD
gi|9247092|         QESFAATADFREQILRVKEDENVPFLLVGNKSDLEDKRQVSVEEAKSRAD 160       170       180       190       200
                    ....|....|....|....|....|....|....|....|....|....|
NOV3 GSAC068993_A   QWNVNYVETSAKIQANVDKVLFDLMREIRAKKMEDSKEKNGKKKRKSSAK
gi|9507025|         QWNVNYVETSAKIRANVDKVFFDLMREIRARKMEDSKEKNGKKKRKSLAK
gi|14740792|        QWNVNYVETSAKIRANVDKVFFDLMREIRARKMEDSKEKNGKKKRKSLAK
gi|12851417|        QWNVNYVETSAKIRANVDKVFFDLMREIRARKMEDSKEKNGKKKRKSLAK
gi|4885569|         QWNVNYVETSAKIRANVDKVFFDLMREIRARKMEDSKEKNGKKKRKSLAK
gi|9247092|         QWNVNYVETSAKIRANVDKVFFDLMREIRARKMEDSKEKNGKKKRKSLAK

....|....
NOV3 GSAC068993_A   RIRERCCIL
gi|9507025|         RIRERCCIL
gi|14740792|        RIRERCCIL
gi|12851417|        RIRERCYIL
gi|4885569|         RIRERCCIL
gi|9247092|         RIRERCCIL
```

The presence of identifiable domains in NOV3 was determined as described in NOV1. n addition, this protein contains the following protein domains (as defined by Interpro) at the indicated nucleotide positions: domain name arf against NOV3. This indicates that the NOV3 sequence has properties similar to those of other proteins known to contain these domains and similar to the properties of these domains.

TABLE 3F

Domain Analysis of NOV3

| PSSMs producing significant alignments: | | | Score (bits) | Evalue |
|---|---|---|---|---|
| gnl|Smart|smart00173 | RAS, | Ras subfamily of RAS small GTPases; Similar | 214 | 5e–57 |
| gnl|Pfam|pfam00071 | ras, | Ras family. Includes sub-families Ras, Rab, | 180 | 8e–47 |
| gnl|Smart|smart00175 | RAB, | Rab subfamily of small GTPases; Rab GTPases | 123 | 1e–29 |
| gnl|Smart|smart00174 | RHO, | Rho (Ras homology) subfamily of Ras-like | 88.6 | 3e–19 |
| gnl|Smart|smart00176 | RAN, | Ran (Ras-related nuclear proteins) /TC4 subfam | 64.3 | 6e–12 |

TABLE 3F-continued

Domain Analysis of NOV3

| PSSMs producing significant alignments: | | | Score (bits) | Evalue |
|---|---|---|---|---|
| gnl\|Smart\|smart00178 | SAR, | Sarlp-like members of the Ras-family of small | 38.5 | 4e−04 |
| gnl\|Pfam\|pfam00025 | arf, | ADP-ribosylation factor family. Pfam combines | 36.2 | 0.002 | gnl|Smart|smart00173, RAS, Ras subfamily of RAS small GTPases; Similar in fold and function to the bacterial EF-Tu GTPase. p21Ras couples receptor Tyr kinases and G protein receptors to protein kinase cascades. CD-Length = 166 residues, 97.6% aligned
gnl|Pfam|pfam00071, ras, Ras family. Includes sub-families Ras, Rab, Rac, Ral, Ran, Rap Ypt1 and more. Shares P-loop motif with GTP_EFTU, arf and myosin_head. See pfam00009 pfam00025, pfam00063. The high cutoff is so high to avoid overlaps with related families. CD-Length = 190 residues, 84.7% aligned
gnl|Smart|smart00175, RAB, Rab subfamily of small GTPases; Rab GTPases are implicated in vesicle trafficking. CD-Length = 161 residues, 99.4% aligned
gnl|Smart|smart00174, RHO, Rho (Ras homology) subfamily of Ras-like small GTPases; Members of this subfamily of Ras-like small GTPases include Cdc42 and Rac, as well as Rho isoforms. CD-Length = 174 residues, 93.7% aligned
gnl|Smart|smart00176, RAN, Ran (Ras-related nuclear proteins)/TC4 subfamily of small GTPases; Ran is involved in the active transport of proteins through nuclear pores. CD-Length = 200 residues, only 76.5% aligned
gnl|Smart|smart00178, SAR, Sarlp-like members of the Ras-family of small GTPases; Yeast SAR1 is an essential gene required for transport of secretory proteins from the endoplasmic reticulum to the Golgi apparatus. CD-Length = 184 residues, only 66.8% aligned
gnl|Pfam|pfam00025, arf, ADP-ribosylation factor family. Pfam combines a number of different Prosite families together. CD-Length = 179 residues, only 50.8% aligned The disclosed NOV3 nucleic acid encoding a Ras-related protein-like protein includes the nucleic acid whose sequence is provided in Table 3A, or variant thereof, including a SNP, fragment, homology, analog of the sequence is provided in Table 3A. The invention also includes a mutant or variant nucleic acid any of whose bases may be changed from the corresponding base shown in Table 3A while still encoding a protein that maintains its Ras-related protein-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 13% percent of the bases may be so changed.

The disclosed NOV3 protein of the invention includes the Ras-related protein-like protein whose sequence is provided in Table 3B. The invention also includes a mutant or variant protein any of whose residues may be changed from the corresponding residue shown in Table 3B while still encoding a protein that maintains its Ras-related protein-like activities and physiological functions, or a functional fragment thereof. In the mutant or variant protein, up to about 11% percent of the residues may be so changed.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The Ras-Related protein disclosed in this invention is expressed in at least the following tissues: colon tumor, liver, spleen, parathyroid_tumor, ovary and uterus, lung. This information was derived by determining the tissue sources of the sequences that were included in the invention, PublicEST sources: colon tumor, liver, spleen, parathyroid_tumor, ovary and uterus, lung. In addition, the sequence is predicted to be expressed in the following tissues because of the expression pattern of (GenBank-ID: gb:GenBank-ID:RATRALA|acc:L19698) a closely related {Rat GTP-binding protein (ral A) mRNA, complete cds homolog in species *Rattus norvegicus*: colon tumor, liver, spleen, parathyroid_tumor, ovary and uterus, lung.

The protein similarity information, expression pattern, and map location for the Ras-Related protein-like protein and nucleic acid disclosed herein suggest that this Ras-Related protein may have important structural and/or physiological functions characteristic of the Ras-Related protein family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

The structural similarities indicate that NOV3 may function as a member of Ras-related protein family proteins. Accordingly, the NOV3 nucleic acids and proteins identified here may be useful in potential therapeutic applications implicated in (but not limited to) various pathologies and disorders as indicated herein. For example, a cDNA encoding the Ras-related protein-like protein NOV3 may be useful in gene therapy, and the Ras-related protein-like protein NOV3 may be useful when administered to a subject in need thereof. The NOV3 nucleic acid encoding Ras-related protein-like protein, and the Ras-related protein-like protein of the invention, or fragments thereof, may further be useful in diagnostic applications, wherein the presence or amount of the nucleic acid or the protein are to be assessed. Additional disease indications and tissue expression for NOV3 and NOV3 variants, if available, are presented in the Examples.

Based on the tissues in which NOV3 is most highly expressed, specific uses include developing products for the diagnosis or treatment of a variety of diseases and disorders associated therewith. Specific expression of NOV3 in normal and diseased tissues are shown in the Examples.

NOV3 nucleic acids and polypeptides are further useful in the generation of antibodies that bind immuno-specifically to the novel NOV3 substances for use in therapeutic or diagnostic methods. These antibodies may be generated according to methods known in the art, using prediction from hydrophobicity charts, as described in the "Anti-NOVX Antibodies" section below. The disclosed NOV3 protein has multiple hydrophilic regions, each of which can be used as an immunogen. In one embodiment, a contemplated NOV3 epitope is from about amino acids 1 to 20. In another embodiment, a NOV3 epitope is from about amino acids 30 to 80. In additional embodiments, NOV3 epitopes are from about amino acids 95 to 206. These novel proteins can be used in assay systems for functional analysis of various human disorders, which will help in understanding of pathology of the disease and development of new drug targets for various disorders.

NOV4

A disclosed NOV4 nucleic acid (SEQ ID NO:7) of 723 nucleotides (also referred to as GSAC022510_A) encoding a novel Serine Threonine Protein Kinase-like protein is shown in Table 4A. An open reading frame was identified beginning with an ATG initiation codon at nucleotides 60–62 and ending with a TAA codon at nucleotides 702–704. Putative untranslated regions are found upstream from the initiation codon and downstream from the termination codon, and are underlined. The start and stop codons are shown in bold letters in Table 4A.

TABLE 4A

NOV4 nucleotide sequence (SEQ ID NO:7).

<u>TACACCGCCCGCCTGGTGGATCAGAAATGGCTGCGACTCGCGGCGAGGAGAAAATCTGC</u>ATGAGCATGTA

TCAACGCATTAATGGCGCTGACTGGCGCAATATTTTCGTCGTCGGCGATCTGCATGGGTGCTACACGCTG

CTGATGAATGAACTCGAAAAGGTTTCGTTCGACCCTGCGTGTGATTTGCTGATTTCGGTTGGAGACCTTG

TTGACCGCGGCGCGGAAAACGTCGAGTGCCTGGAGCTGATTACTATGCCTTGGTTCCGGGCTGTCCGAGG

TAACCATGAGCAGATGATGATTGATGGGCTATCGGAGTATGGAAACOTTAACCACTGGCTGGAAAACGCG

GGGGGGTGGTTCCTCAGTCCTGATTATGAAAAAGAGGGGCTGGCTAAGGCTCTGGTTCATAAATGGCCA

GCCTGCCATTCGTCATCGAGCTGGTTACCGCTGAACGTAAAATGGGTATTTGCCCCGCTGACTACCCGCA

TAACGAAAATGGCGTCAAAAGGCCGTCCCAAAGAAATGTCCTTTTGAATCGGGAACGGGTTACCACCCCT

AGAACGGATTTGGCCCCCCCAAAGCCGTGGGCTGATCTGTTTATTTTTTGGGCCCAACCCCTCGGGGGCC

CAGCCCCCTGGAAGTTTGCCCACCACAAATGTCAATCTATAACCGGGGGCGCGCGGTTCTGTGGGAAACA

CTAA<u>CCCTCTGGGACAAGGGGAA</u>

A disclosed NOV4 polypeptide (SEQ ID NO:8) encoded by SEQ ID NO:7 has 214 amino acid residues and is presented in Table 4B using the one-letter amino acid code. SignalP, Psort and/or Hydropathy results predict that NOV4 has no known signal peptide and is likely to be localized microbody (peroxisome) with a certainty of 0.5584. In an alternative embodiment, NOV4 is likely to be localized to the cytoplasm with a certainty of 0.4500, or to the lysosome (lumen) with a certainty of 0.2226, or to the mitochondrial matrix space with a certainty of 0.1000. NOV4 has a molecular weight of 24231.56 Daltons.

TABLE 4B

Encoded NOV4 protein sequence (SEQ ID NO:8.)

MSMYQRINGADWRNIFVVGDLHGCYTLLMNELEKVSFDPACDLLISVGDLVDRGAENVECLELITMPWFR

AVRGNHEQMMIDGLSEYGNVNHWLENAGGWFLSPDYEKEGLAKALVHKWASLPFVIELVTAERKMGICPA

DYPHNENGVKRPSQRNVLLNRERVTTPRTDLAPPKPWADLFIFWAQPLGGPAPWKFAHHKCQSITGGARF

CGKH

Genomic clone(s) AC022509 on chromosome 12 were identified by TBLASTN using proprietary sequence file for members of Ras-Related protein and/or Ras-Related protein family, run against the genomic daily files made available by GenBank or obtained from Human Genome Project Sequencing centers, and further analyzed as described for NOV1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database that contains sequences published in patents and patent publications.

Patp results include those listed in Table 4C.

TABLE 4C

Patp BLASTP Analysis for NOV4

| Sequences producing High-scoring Segment Pairs | Protein/Organism | Length (aa) | Identity (%) | Positive (%) | E value |
|---|---|---|---|---|---|
| patp: AAO05143 | Human polypeptide clone no: 19035 - *Homo sapiens* | 148 | 86/139 (61%) | 99/139 (71%) | 7.5e−41 |
| patp: AAB59077 | Breast and ovarian cancer associated antigen protein sequence clone no: 785 - *Homo sapiens* | 61 | 53/60 (88%) | 54/60 (90%) | 2.0e−24 |
| patp: AAO12103 | Human polypeptide clone no: 25995 - *Homo sapiens* | 90 | 47/77 (61%) | 54/77 (70%) | 5.8e−18 |
| patp: AAY99810 | Wheat partial protein phosphatase-1 - *Triticum aestivum* | 102 | 27/68 (39%) | 39/68 (57%) | 0.00020 |
| patp: AAM81225 | Human haematological malignancy-related antigen #923 - *Homo sapiens* | 145 | 31/75 (41%) | 42/75 (56%) | 0.00091 |

In a search of sequence databases, it was found, for example, that the nucleic acid sequence of this invention has 458 of 697 bases (65%) identical to a gb:GenBank-ID:LAMCG|acc:J02459 mRNA from bacteriophage lambda (Bacteriophage lambda, complete genome). The full amino acid sequence of the protein of the invention was found to have 126 of 212 amino acid residues (59%) identical to, and 150 of 212 amino acid residues (70%) similar to, the 221 amino acid residue ptnr:SWISSPROT-ACC:P03772 protein from Bacteriophage lambda (Serine/Threonine Protein Phosphatase (EC 3.1.3.16)).

In a further search of public sequence databases, NOV4 was found to have homology to the amino acid sequences shown in the BLASTP data listed in Table 4D.

TABLE 4D

BLASTP results for NOV4

| Gene Index/ Identifier | Protein/Organism | Length (aa) | Identity (%) | Positives (%) | Expect |
|---|---|---|---|---|---|
| gi|13399474| pdb|1G5B|A | Chain A, Bacteriophage Lambda SerTHR PROTEIN PHOSPHATASE | 221 | 126/213 (59%) | 150/213 (70%) | 2e−65 |

TABLE 4D-continued

BLASTP results for NOV4

| Gene Index/ Identifier | Protein/Organism | Length (aa) | Identity (%) | Positives (%) | Expect |
|---|---|---|---|---|---|
| gi\|9626305\| ref\|NP_040641.1\| NC_001416 | Nin 221 (pept unknown; 221) [bacteriophage lambda | 221 | 126/213 (59%) | 150/213 (70%) | 3e-65 |
| gi\|15803156\| ref\|NP_289188.1\| NC_002655 | unknown protein encoded by prophage CP-933Y [*Escherichia coli* O157: H7 EDL933] | 221 | 125/213 (58%) | 149/213 (69%) | 3e-64 |
| gi\|16765194\| ref\|NP_460809.1\| NC_003197 | serine/threonine protein phosphatase [*Salmonella typhimurium* LT2] | 216 | 81/212 (38%) | 113/212 (53%) | 3e-30 |
| gi\|16760741\| ref\|NP_456358.1\| NC_003198 | serine/threonine protein phosphatase 1 [*Salmonella enterica* subsp. enterica serovar Typhi] | 216 | 81/212 (38%) | 113/212 (53%) | 3e-30 |

The homology of these and other sequences is shown graphically in the ClustalW analysis shown in Table 4E. The NOV4 polypeptide is provided in lane 1.

TABLE 4E

ClustalW Analysis of NOV4

1) Novel NOV4 (SEQ ID NO:8)
2) gi|13399474 (SEQ ID NO:68)
3) gi|9626305 (SEQ ID NO:69)
4) gi|15803156 (SEQ ID NO:70)
5) gi|16765194 (SEQ ID NO:71)
6) gi|16760741 (SEQ ID NO:72)

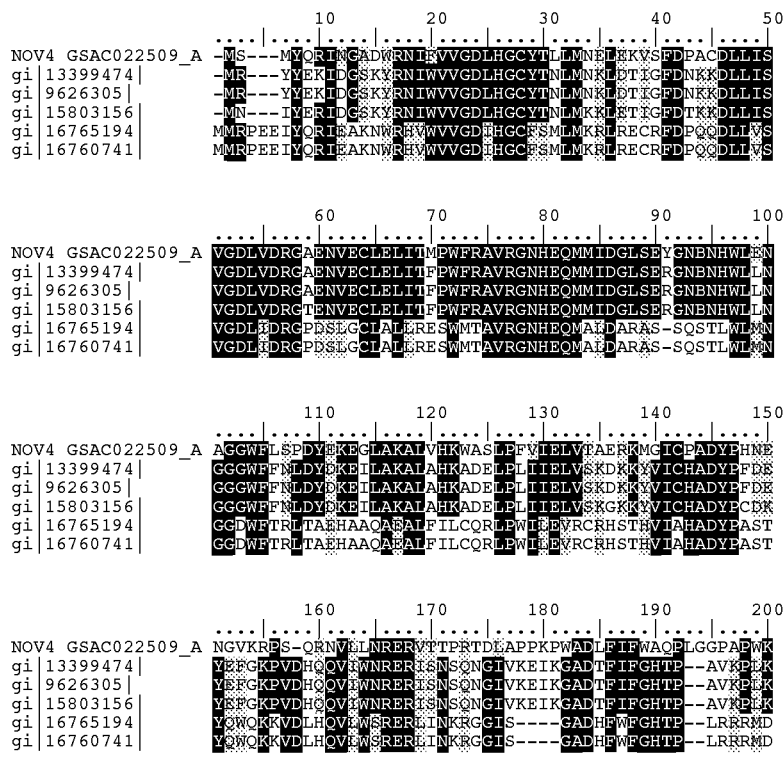

TABLE 4E-continued

ClustalW Analysis of NOV4

```
                            210        220
                       ....|....|....|....|....|....
NOV4 GSAC022509_A      FAHHKCQSITGGARFCGKH----------
gi|13399474|           FANQ--MYIDTGAVFCGNLTLIQVQGAGA
gi|9626305|            FANQ--MYIDTGAVFCGNLTLIQVQGEGA
gi|15803156|           FANQ--MYIDTGAVFCGNLTLIQVQGEGA
gi|16765194|           FANV--HYIDTGAVFGGQLTLARIQ----
gi|16760741|           FANI--HYIDTGAVFGGQLTLARIQ----
```

The presence of identifiable domains in NOV4 was determined as described in NOV1. Table 4F lists the domain description from DOMAIN analysis results against NOV4. This indicates that the NOV4 sequence has properties similar to those of other proteins known to contain these domains.

TABLE 4F

Domain Analysis of NOV4

| PSSMs producing significant alignments: | | Score (bits) | Evalue |
|---|---|---|---|
| gnl\|Pfam\|pfam00149 | STphosphatase, Ser/Thr protein phosphatase | 45.1 | 4e−06 |
| gnl\|Smart\|smart00156 | PP2Ac, Protein phosphatase 2A homologues, | 44.7 | 6e−06 | gnl|Pfam|pfam00149, STphosphatase, Ser/Thr protein phosphatase. CD-Length = 287 residues, only 31.4% aligned
gnl|Smart|smart00156, PP2Ac, Protein phosphatase 2A homologues, catalytic domain.; Large family of serine/threonine phosphatases, that includes PP1, PP2A and PP2B (calcineurin) family members. CD-Length = 271 residues, only 25.1% aligned The disclosed NOV4 nucleic acid encoding a Serine Threonine Protein Kinase-like protein includes the nucleic acid whose sequence is provided in Table 4A, or variant thereof, including a SNP, fragment, homology, analog of the sequence is provided in Table 4A. The invention also includes a mutant or variant nucleic acid any of whose bases may be changed from the corresponding base shown in Table 4A while still encoding a protein that maintains its Serine Threonine Protein Kinase-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 35% percent of the bases may be so changed.

The disclosed NOV4 protein of the invention includes the Serine Threonine Protein Kinase-like protein whose sequence is provided in Table 4B. The invention also includes a mutant or variant protein any of whose residues may be changed from the corresponding residue shown in Table 4B while still encoding a protein that maintains its Serine Threonine Protein Kinase-like activities and physiological functions, or a functional fragment thereof. In the mutant or variant protein, up to about 41% percent of the residues may be so changed.

The invention further encompasses antibodies and antibody fragments, such as $F_{ab}$ or, $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The protein similarity information, expression pattern, and map location for the Serine/Threonine Protein Phosphatase-like protein and nucleic acid disclosed herein suggest that this Serine/Threonine Protein Phosphatase may have important structural and/or physiological functions characteristic of the Serine/Threonine Protein Phosphatase family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

The structural similarities indicate that NOV4 may function as a member of Serine Threonine Protein Kinase family proteins. Accordingly, the NOV4 nucleic acids and proteins identified here may be useful in potential therapeutic applications implicated in (but not limited to) various pathologies and disorders as indicated herein. For example, a cDNA encoding the Serine Threonine Protein Kinase-like protein NOV4 may be useful in gene therapy, and the Serine Threonine Protein Kinase-like protein NOV4 may be useful when administered to a subject in need thereof. The NOV4 nucleic acid encoding Serine Threonine Protein Kinase-like protein, and the Serine Threonine Protein Kinase-like protein of the invention, or fragments thereof, may further be useful in diagnostic applications, wherein the presence or amount of the nucleic acid or the protein are to be assessed. Additional disease indications and tissue expression for NOV4 and NOV4 variants, if available, are presented in the Examples.

Based on the tissues in which NOV4 is most highly expressed, specific uses include developing products for the diagnosis or treatment of a variety of diseases and disorders associated therewith. Specific expression of NOV4 in normal and diseased tissues are shown in the Examples.

NOV4 nucleic acids and polypeptides are further useful in the generation of antibodies that bind immuno-specifically to the novel NOV4 substances for use in therapeutic or diagnostic methods. These antibodies may be generated according to methods known in the art, using prediction from hydrophobicity charts, as described in the "Anti-NOVX Antibodies" section below. The disclosed NOV4 protein has multiple hydrophilic regions, each of which can be used as an immunogen. In one embodiment, a contemplated NOV4 epitope is from about amino acids 1 to 35. In another embodiment, a NOV4 epitope is from about amino acids 55 to 125. In additional embodiments, NOV4 epitopes are from about amino acids 135 to 180, and from about amino acids 185 to 214. These novel proteins can be used in assay systems for functional analysis of various human disorders, which will help in understanding of pathology of the disease and development of new drug targets for various disorders.

NOV5

A disclosed NOV5 nucleic acid (SEQ ID NO:9) of 2304 nucleotides (also referred to as GSAC022509_A) encoding a novel SHARP-1-like protein is shown in Table 5A. An open reading frame was identified beginning with an ATG initiation codon at nucleotides 1–3 and ending with a TGA codon at nucleotides 2302–2304. Putative untranslated regions are contemplated upstream from the initiation codon and downstream from the termination codon. The start and stop codons are shown in bold letters in Table 5A.

TABLE 5A

NOV5 nucleotide sequence (SEQ ID NO:9).

ATGCCTTTCTCCTGGAAGCTGCTCTCTTCAAGCCAACTGCCAGAGGCAGAAGGCACAGCTGCAGCGACAG

GACAACCACACGACAGGACTCCGGAGACTGCAGCAGCGCGAGCGGCCGCCGCGGCCCGGGCTGCTCCTGG

AGTCGGGGAGGAGACGCGACTCCCGCAGACACGTGACCTCCTCCCAGCCGCCGCTTCCCGCGACCCAGAT

CCGTCCCCGGAACCCGTGCCCGGCGGGGCGGGCCGGGGACACGGCGAGCGCGCGCGCACGGGTTCCC

CGAGCAGTGATGTGGCAGCAGCGGCAGGTCGGATCACGTTGCTGGCCCTGTGCTGGTACCCGTTTGAGAC

CGGATTAAGGAGGGAGGCTTTGGAGGTGCCAGCGGTAGTAAACCCCCCACTCAACCCCGGCTCGCTCCCC

GCCGCGTTCCTCCAGGAGCACACGCGGCCCCAAACGTCGTCATCTGCTGCTGTGATTAGTGGCACCGCAA

TTCCGGCTGATGCGGGAAGTTTAGTTGGCCCAGGGACGCCGTGTCACCGAAAGACACTTGGATTGCGACA

TTTCGACCCAGTGACAACGTTTTCATGTATCTTAAATCCTTCAGGAGCGGATCGCAAGTTGCTTCTTCTC

GAGGCAACCTCTCCACCCAGCGCCAACGAGTCCCTCCAGGCCACTGATCACGCGGTGGAGGGGGGGACC

AACTGCTTCACACTTTCAACACTGCACTGAAGAGGGAGAGCGAGAGAGAGACTGGAGACGCACAGATCCC

CCCAAGGTCTCCCAAGCCTACCGTCCCACAGATTATTGTACAGAGCCCCAAAAATCGAAACAGAGGAAAC

GAACAGCAGTTGAACATGGACGAAGGAATTCCTCATTTGCAAGAGAGACAGTTACTGGAACATAGAGATT

TTATAGGACTGGACTATTCCTCTTTGTATATGTGTAAACCCAAAAGGAGCATGAAACGAGACGACACCAA

GGATACCTACAAATTACCGCACAGATTAATAGAAAAGAAAAGAAGAGACCGAATTAATGAATGCATTGCT

CAGCTGAAAGATTTACTGCCTGAACATCTGAAATTGACAACTCTGGGACATCTGGAGAAAGCTGTAGTCT

TGGAATTAACTTTGAAACACTTAAAAGCTTTAACCGCCTTAACCGAGCAACAGCATCAGAAGATAATTGC

TTTACAGAATGGGGAGCGATCTCTGAAATCGCCCATTCAGTCCGACTTGGATGCGTTCCACTCGGGATTT

CAAACATGCGCCAAAGAAGTCTTGCAATACCTCTCCCGGTTTGAGAGCTGGACACCCAGGGAGCCGCGGT

GTGTCCAGCTGATCAACCACTTGCACGCCGTGGCCACCCAGTTCTTGCCCACCCCGCAGCTGTTGACTCA

ACAGGTCCCTCTGAGCAAAGGCACCGCCGCTCCCTCGGCCGCCGGGTCCGCGGCCGCCCCCTGCCTGGAG

CGCGCGGGGCAGAAGCTGGAGCCCCTCGCCTACTGCGTGCCCGTCATCCAGCGGACTCAGCCCAGCGCCG

TABLE 5A-continued

NOV5 nucleotide sequence (SEQ ID NO:9).

AGCTCGCCGCCGAGAACGACACGGACACCGACAGCGGCTACCGCCGCGAAGCCGAGGCCCGGCCGGACCG

CGAGAAAGGCAAAGGCGCGGGGGCGAGCCGCGTCACCATCAAGCAGGAGCCTCCCGGGGAGGACTCGCCG

GCGCCCAAGAGGATGAAGCTGGATTCCCGCGGCGGCGGCAGCGGCGGCGGCCCGGGGGGCGGCGCGGCGG

CGGCGGCAGCCGCGCTTCTGGGGCCCGACCCTGCCGCCGCGGCCGCGCTGCTGAGACCCGACGCCGCCCT

GCTCAGCTCGCTGGTGGCGTTCGGCGGAGGCGGAGGCGCGCCCTTCCCGCAGCCCGCGGCCGCCGCGGCC

CCCTTCTGCCTGCCCTTCTGCTTCCTCTCGCCTTCTGCAGCTGCCGCCTACGTGCAGCCCTTCCTGGACA

AGAGCGGCCTGGAGAAGTATCTGTACCCGGCGGCGGCTGCCGCCCCGTTCCCGCTGCTATACCCCGGCAT

CCCCGCCCCGGCGGCAGCCGCGGCAGCCGCCGCCGCCGCTGCCGCCGCCGCCGCCGCGTTCCCCTGCCTG

TCCTCGGTGTTGTCGCCCCCTCCCGAGAAGGCGGGCGCCGCCGCCGCGACCCTCCTGCCGCACGAGGTGG

CGCCCCTTGGGGCGCCGCACCCCCAGCACCCGCACGGCCGCACCCACCTGCCCTTCGCCGGGCCCCGCGA

GCCGGGGAACCCGGAGAGCTCTGCTCAGGAAGATCCCTCGCAGCCAGGAAAGGAACCTCCCTGA

A disclosed NOV5 polypeptide (SEQ ID NO:10) encoded by SEQ ID NO:9 has 767 amino acid residues and is presented in Table 5B using the one-letter amino acid code. SignalP, Psort and/or Hydropathy results predict that NOV5 has no known signal peptide and is likely to be localized plasma membrane with a certainty of 0.7000. In an alternative embodiment, NOV5 is likely to be localized to the nucleus with a certainty of 0.3000, or to the endoplasmic reticulum (membrane) with a certainty of 0.2000, or to the mitochondrial inner membrane with a certainty of 0. 1000. NOV5 has a molecular weight of 80292.17 Daltons.

members of Ras-Related protein and/or Ras-Related protein family, run against the genomic daily files made available by GenBank or obtained from Human Genome Project Sequencing centers, and further analyzed as described for NOV1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database that contains

TABLE 5B

Encoded NOV5 protein sequence (SEQ ID NO:10).

MPFSWKLLSSSQLPEAEGTAAGTGQPQDRTPETAAARAAAAARAAPGVGEETRLPQTRDLLPAAASRDPD

PSPEPVPGGAGRGTRRARARTGSPSSDVAAAAGRITLLALCWYPFETGLRREALEVPAVVNPPLNPGSLP

AAFLQEHTRPQTSSSAAVISGTAIPADAGSLVGPGTPCHRKTLGLRHFDPVTTFSCILNPSGADRKLLLL

EATSPPSAXESLQATDHAVEGGDQLLHTFNTALKRESERETGDAQIPPRSPKPTVPQIIVQSPKNRNRGN

EQQLNNDEGIPHLQERQLLEHRDFIGLDYSSLYMCKPKRSMKRDDTKDTYKLPHRLIEKKRRDRINECIA

QLKDLLPEHLKLTTLGHLEKAVVLELTLKHLKALTALTEQQHQKIIALQNGERSLKSPIQSDLDAFHSGF

QTCAKEVLQYLSRFESWTPREPRCVQLINHLHAVATQFLPTPQLLTQQVPLSKGTGAPSAAGSAAAPCLE

RAGQKLEPLAYCVPVIQRTQPSAELAAENDTDTDSGYGGEAAARPDRERGKGAGASRVTIKQEPPGEDSP

APKRNKLDSRGGGSGGGPGGGAAAAAAALLGPDPAAAAALLRPDAALLSSLVAFGGGGGAPFPQPAAAAA

PFCLPFCFLSPSAAAAYVQPFLDKSGLEKYLYPAAAPFPLLYPGIPAPAAAAAAAAAAAAAAAAAFPCL

SSVLSPPPEKAGAAAATLLPHEVAPLGAPHPQHPHGRTHLPFAGPREPGNPESSAQEDPSQPGKEAP

Genomic clones for AC022509 on chromosome 12 were identified by TBLASTN using proprietary sequence file for sequences published in patents and patent publications. Patp results include those listed in Table 5C.

TABLE 5C

Patp BLASTP Analysis for NOV5

| Sequences producing High-scoring Segment Pairs | Protein/Organism | Length (aa) | Identity (%) | Positive (%) | E Value |
|---|---|---|---|---|---|
| patp: AAB70692 | Human DEC2a protein sequence clone no: 2 - *Homo sapiens* | 482 | 482/482 (100%) | 482/482 (100%) | 1.6e−260 |
| patp: AAB70693 | Human DEC2b protein sequence clone no: 12 - *Homo sapiens* | 484 | 482/484 (99%) | 482/484 (99%) | 2.3e−259 |
| patp: AAB70694 | Mouse DEC2a protein sequence clone no: 14 - *Mus musculus* | 410 | 253/368 (68%) | 273/368 (74%) | 6.2e−108 |
| patp: AAU16188 | Human novel secreted protein, clone no 1141 - *Homo sapiens* | 165 | 165/165 (100%) | 165/165 (100%) | 3.5e−86 |
| patp: AAU16603 | Human novel secreted protein, clone no 1556 - *Homo sapiens* | 150 | 148/150 (98%) | 148/150 (98%) | 2.7e−75 |

In a search of sequence databases, it was found, for example, that the nucleic acid sequence of this invention has 988 of 1352 bases (73%) identical to a gb:GenBank-ID:AF009329 |acc:AF009329 mRNA from *Rattus norvegicus* (*Rattus norvegicus* enhancer-of-split and hairy-related protein 1 (Sharp-1) mRNA, complete cds). The full amino acid sequence of the protein of the invention was found to have 207 of 247 amino acid residues (83%) identical to, and 218 of 247 amino acid residues (88%) similar to, the 253 amino acid residue ptnr:SptrEmbl-ACC No. O35779 protein from *Rattus norvegicus* (Enhancer-of-Split and Hairy-related protein 1).

In a further search of public sequence databases, NOV5 was found to have homology to the amino acid sequences shown in the BLASTP data listed in Table 5D.

TABLE 5D

BLASTP results for NOV5

| Gene Index/Identifier | Protein/Organism | Length (aa) | Identity (%) | Positives (%) | Expect |
|---|---|---|---|---|---|
| gi|13540521| ref|NP_110389.1| NM_030762 | basic helix-loop-helix domain containing, class B, 3; bHLH protein DEC2 [*Homo sapiens*] | 482 | 482/482 (100%) | 482/482 (100%) | 0.0 |
| gi|13277378| ref|NP_077789.1| NM_024469 | basic helix-loop-helix domain containing, class B, 3; basic helix-loop-helix domain containing, class B, 2-like [*Mus Musculus*] | 410 | 340/483 (70%) | 359/483 (73%) | e−135 |
| gi|2267587| gb|AAB63586.1| AF009329 | enhancer-of-split and hairy-related protein 1 [*Rattus norvegicus* | 253 | 212/280 (75%) | 224/280 (79%) | e−102 |
| gi|1707585| emb|CAA69169.1| Y07836 | basic-helix-loop-helix protein [*Mus musculus*] | 404 | 179/405 (44%) | 224/405 (55%) | 1e−56 |
| gi|6755680| ref|NP_035628.1| NM_011498 | basic helix-loop-helix domain containing, class B2; eip1 (E47 interaction protein 1); cytokine response gene 8; stimulated by retinoic acid 14 [*Mus musculus*] | 411 | 178/405 (43%) | 221/405 (53%) | 3e−56 |

The homology of these and other sequences is shown graphically in the ClustalW analysis shown in Table 5E. The NOV5 polypeptide is provided in lane 1.

TABLE 5E

ClustalW Analysis of NOV5

1) Novel NOV5 (SEQ ID NO:10)
2) gi|13540521 (SEQ ID NO:73)
3) gi|13277378 (SEQ ID NO:74)
4) gi|2267587 (SEQ ID NO:75)
5) gi|1707585 (SEQ ID NO:76)
6) gi|6755680 (SEQ ID NO:77)

```
                          10        20        30        40        50
                 ....|....|....|....|....|....|....|....|....|....|
NOV5 GSAC022509_A MPFSWKLLSSSQLPEAEGTAAGTGQPQDRTPETAAARAAAAARAAPGVGE
gi|13540521      --------------------------------------------------
gi|13277378      --------------------------------------------------
gi|2267587       --------------------------------------------------
gi|1707585       --------------------------------------------------
gi|6755680       --------------------------------------------------

60        70        80        90       100
                 ....|....|....|....|....|....|....|....|....|....|
NOV5 GSAC022509_A ETRLPQTRDLLPAAASRDPDPSPEPVPGGAGRGTRRARARTGSPSSDVAA
gi|13540521      --------------------------------------------------
gi|13277378      --------------------------------------------------
gi|2267587       --------------------------------------------------
gi|1707585       --------------------------------------------------
gi|6755680       --------------------------------------------------

110       120       130       140       150
                 ....|....|....|....|....|....|....|....|....|....|
NOV5 GSAC022509_A AAGRITLLALCWYPFETGLRREALEVPAVVNPPLNPGSLPAAFLQEHTRP
gi|13540521      --------------------------------------------------
gi|13277378      --------------------------------------------------
gi|2267587       --------------------------------------------------
gi|1707585       --------------------------------------------------
gi|6755680       --------------------------------------------------

160       170       180       190       200
                 ....|....|....|....|....|....|....|....|....|....|
NOV5 GSAC022509_A QTSSSAAVISGTAIPADAGSLVGPGTPCHRKTLGLRHFDPVTTFSCILNP
gi|13540521      --------------------------------------------------
gi|13277378      --------------------------------------------------
gi|2267587       --------------------------------------------------
gi|1707585       --------------------------------------------------
gi|6755680       --------------------------------------------------

210       220       230       240       250
                 ....|....|....|....|....|....|....|....|....|....|
NOV5 GSAC022509_A SGADRKLLLLEATSPPSAKESLQATDHAVEGGDQLLHTFNTALKRESERE
gi|13540521      --------------------------------------------------
gi|13277378      --------------------------------------------------
gi|2267587       --------------------------------------------------
gi|1707585       --------------------------------------------------
gi|6755680       --------------------------------------------------

260       270       280       290       300
                 ....|....|....|....|....|....|....|....|....|....|
NOV5 GSAC022509_A TGDAQIPPRSPKPTVPQIIVQSPKNRNRGNEQQLNMDEGIPHLQERQLLE
gi|13540521      -----------------------------------MDEGIPHLQERQLLE
gi|13277378      -----------------------------------MDEGIPHLQERQLLE
gi|2267587       -----------------------------------MDEGIPHLQERQLLE
gi|1707585       ------------------------------------QPPPTCLPKAPGLE
gi|6755680       ---------------------------MERIPSAQPPPTCLPKAPGLE 310       320       330       340       350
                 ....|....|....|....|....|....|....|....|....|....|
NOV5 GSAC022509_A HRDFIGLDYSSLY-MCKPKRSMKR-DDTKDTYKLPHRLIEKKRRDRINEC
gi|13540521      HRDFIGLDYSSLY-MCKPKRSMKR-DDTKDTYKLPHRLIEKKRRDRINEC
gi|13277378      HRDFIGLDYSSLY-MCKPKRSMKR-DDTKDTYKLPHRLIEKKRRDRINEC
gi|2267587       HRDFIGLDYSSLY-MCKPKRSMKR-DDTKDTYKLPHRLIEKKRRDRINEC
gi|1707585       HGDLSGMDFAHMYQVYKSRRGIKRSEDSKETYKLPHRLIEKKRRDRINEC
gi|6755680       HGDLSGMDFAHMYQVYKSRRGIKRSEDSKETYKLPHRLIEKKRRDRINEC 360       370       380       390       400
                 ....|....|....|....|....|....|....|....|....|....|
NOV5 GSAC022509_A IAQLKDLLPEHLKLTTLGHLEKAVVLELTLKHLKALTALTEQQHQKIIAL
gi|13540521      IAQLKDLLPEHLKLTTLGHLEKAVVLELTLKHLKALTALTEQQHQKIIAL
gi|13277378      IAQLKDLLPEHLKLTTLGHLEKAVVLELTLKHLKALTALTEQQHQKIIAL
gi|2267587       IAQLKDLLPEHLKLTTLGHLEKAVVLELTLKHLKALTALTEQQHQKIIAL
gi|1707585       IAQLKDLLPEHLKLTTLGHLEKAVVLELTLKHMKALTNLIDQQQKIIAL
gi|6755680       IAQLKDLLPEHLKLTTLGHLEKAVVLELTLKHMKALTNLIDQQQKIIAL
```

TABLE 5E-continued

ClustalW Analysis of NOV5

```
                           410       420       430       440       450
                      ....|....|....|....|....|....|....|....|....|....|
NOV5_GSAC022509_A     QNGERS--LKSP-IQSDLDAFHSGFQTCAKEVLQYLSRFESWTPREPRCV
gi|13540521|          QNGERS--LKSP-IQSDLDAFHSGFQTCAKEVLQYLSRFESWTPREPRCV
gi|13277378|          QNGERS--LKSP-VQADLDAFHSGFQTCAKEVLQYLARFESWTPREPRCA
gi|2267587|           QNGERS--LKSP-VQADLDAFHSGFQTCAKEVLQYLARFESWTPREPRCA
gi|1707585|           QSGLQAGDLSGRNLEAGQEMFCSGFQTCAREVLQYLAKHEN---TRDLKSS
gi|6755680|           QSGLQAGDLSGRNLEAGQEMFCSGFQTCAREVLQYLAKHEN---TRDLKSS 460       470       480       490       500
                      ....|....|....|....|....|....|....|....|....|....|
NOV5_GSAC022509_A     QLINHLHAVATQFLPTPQLLTQQVPLSKGTG-AESAACSAAAPCLERACQ
gi|13540521|          QLINHLHAVATQFLPTPQLLTQQVPLSKGTG-AESAACSAAAPCLERACQ
gi|13277378|          QLVSHLHAVAT------QLLTPQVPSGRCSGRAPCSACAAAASGPER---
gi|2267587|           QLVSHLHAVAT------QLLTPQVTPGRCPGRAPCSACAAAASGPER---
gi|1707585|           QLVPHLHRVVS------ELLQGGASRKPLDS-AEKAVDLKEKPSFLAKCS
gi|6755680|           QLVPHLHRVVS------ELLQGGASRKPLDS-AEKAVDLKEKPSFLAKCS 510       520       530       540       550
                      ....|....|....|....|....|....|....|....|....|....|
NOV5_GSAC022509_A     KLEELAYCVPBIQRT-QPSAELAAENDTDTDSGYGGEABARPDREKGKGA
gi|13540521|          KLEELAYCVPBIQRT-QPSAELAAENDTDTDSGYGGEABARPDREKGKGA
gi|13277378|          ----VARCVPVIQRT-QPGTEP--EHDTDTDSGYGGEABQ---------
gi|2267587|           ----VARCVPVIQRT-QPGTEP--EHDTDTDSGYGGEABQ---------
gi|1707585|           E-GEGKNCVPVIQRTFAPSGGEQSGSDTDTDSGYGGELDK---------
gi|6755680|           E-GEGKNCVPVIQRTFAPSGGEQSGSDTDTDSGYGGELEK---------

560       570       580       590       600
                      ....|....|....|....|....|....|....|....|....|....|
NOV5_GSAC022509_A     GASRVTIKQEPPGEDSPAPKRMKLDSRGGGSGGGPGGGAAAAAAALLGED
gi|13540521|          GASRVTIKQEPPGEDSPAPKRMKLDSRGGGSGGGPGGGAAAAAAALLGED
gi|13277378|          --GRAAVKQEPPGDSSPAPKRPKLEARG---------------------
gi|2267587|           --GRAAVKQEPPGD--------PSLRPRG------------------
gi|1707585|           ----GDLRSEQPYFKSDHGRRFAVGERVS----TIKQESEE-------BP
gi|6755680|           ----GDLRSEQPYFKSDHGRRFAVGERVS----TIKQESEE-------BP 610       620       630       640       650
                      ....|....|....|....|....|....|....|....|....|....|
NOV5_GSAC022509_A     PAAAAALLRPDAALLSSLVAFGGGGAPBPQEAAAAAPFCLPECFLSPSA
gi|13540521|          PAAAAALLRPDAALLSSLVAFGGGGAPBPQEAAAAAPFCLPECFLSPSA
gi|13277378|          -----ALLGPEPALLGSLVALGGG--APEAQP---AAAPFCLPFYLSP-S
gi|2267587|           -------------------------------------------------
gi|1707585|           TTKSRMQLSEEEGHFAGSDLMG----SPELGEHPHQPPFCLPFYLIPP-S
gi|6755680|           TTKSRMQLSEEEGHFAGSDLMG----SPELGEHPHQPPFCLPFYLIPP-S 660       670       680       690       700
                      ....|....|....|....|....|....|....|....|....|....|
NOV5_GSAC022509_A     AAAYVQPFLDKSGLEKYLYEAAAAAPFELLYPGIPAPAAAAAAAAAAAAA
gi|13540521|          AAAYVQPFLDKSGLEKYLYEAAAAAPFELLYPGIPAPAAAAAAAAAAAAA
gi|13277378|          AAAYVQPWLDKSGLDKYLYE-AAAAPFELLYPGIPA------AA---AAAA
gi|2267587|           -------------------------------------------------
gi|1707585|           ATAYL-P-----MLEKCWYE----TSVPYLYPGLNT------S----AAA
gi|6755680|           ATAYL-P-----MLEKCWYE----TSVPYLYPGLNT------S----AAA 710       720       730       740       750
                      ....|....|....|....|....|....|....|....|....|....|
NOV5_GSAC022509_A     AAAEPCLSSVLSEPPEKAGAAA-ATLLEHEVAPLGAPHPQHPHGRTHLPF
gi|13540521|          AAAEPCLSSVLSEPPEKAGAAA-ATLLEHEVAPLGAPHPQHPHGRTHLPF
gi|13277378|          AAAEPCLSSVLSEPPEKAGATAGAPFLAHEVAPPGPLRPQHAHSRTHLPR
gi|2267587|           -------------------------------------------------
gi|1707585|           LSSEMNPDKIPTE----------LLLPQRLPSPLAHSSLDSSALLQALK
gi|6755680|           LSSEMNPDKIPTE----------LLLPQRLPSPLAHSSLDSSALLQALK 760       770
                      ....|....|....|....|
NOV5_GSAC022509_A     AGPREPGNPESSAQEDPSQPGKEAP
gi|13540521|          AGPREPGNPESSAQEDPSQPGKEAP
gi|13277378|          A-----VNPES-SQEDATQPAKDAP
gi|2267587|           -------------------------
gi|1707585|           QIP--PLNLET---------KD--
gi|6755680|           QIP--PLNLET---------KD--
```

The presence of identifiable domains in NOV5 was determined as described in NOV1. The NOV5 protein contains the following protein domains (as defined by Interpro) at the indicated nucleotide positions: domain name Helix-loop-helix DNA-binding domain (PF00010) at amino acid positions 333 to 385, domain name STAT protein domain (PF01017) at amino acid positions 373 to 384, etc. This indicates that the sequence of the invention has properties similar to those of other proteins known to contain this/these domain(s) and similar to the properties of these domains. Table 5F lists the domain description from DOMAIN analysis results against NOV5. This indicates that the NOV5 sequence has properties similar to those of other proteins known to contain these domains.

TABLE 5F

Domain Analysis of NOV5

| PSSMs producing significant alignments: | | Score (bits) | Evalue |
|---|---|---|---|
| gnl\|Smart\|smart00511 | ORANGE, Orange domain; This domain confers | 47.0 | 4e–06 |
| gnl\|Smart\|smart00353 | HLH, helix loop helix domain | 43.9 | 3e–05 |
| gnl\|Pfam\|pfam00010 | HLH, Helix-loop-helix DNA-binding domain | 39.7 | 6e–04 | gnl|Smart|smart00511, ORANGE, Orange domain; This domain confers specificity among members of the Hairy/E(SPL) family. CD-Length = 45 residues, 88.9% aligned gnl|Smart|smart00353, HLH, helix loop helix domain. CD-Length = 53 residues, only 77.4% aligned gnl|Pfam|pfam00010, HLH, Helix-loop-helix DNA-binding domain. CD-Length = 51 residues, 80.4% aligned The disclosed NOV5 nucleic acid encoding a SHARP-1-like protein includes the nucleic acid whose sequence is provided in Table 5A, or variant thereof, including a SNP, fragment, homology, analog of the sequence is provided in Table 5A. The invention also includes a mutant or variant nucleic acid any of whose bases may be changed from the corresponding base shown in Table 5A while still encoding a protein that maintains its SHARP-1-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 27% percent of the bases may be so changed.

The disclosed NOV5 protein of the invention includes the SHARP-1-like protein whose sequence is provided in Table 5B. The invention also includes a mutant or variant protein any of whose residues may be changed from the corresponding residue shown in Table 5B while still encoding a protein that maintains its SHARP-1-like activities and physiological functions, or a functional fragment thereof. In the mutant or variant protein, up to about 17% percent of the residues may be so changed.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The protein similarity information, expression pattern, and map location for the Sharp-1-like protein and nucleic acid disclosed herein suggest that this Sharp-1 may have important structural and/or physiological functions characteristic of the Sharp-1 family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Osteoedystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

In the mammalian central nervous system, a diverse group of basic helix-loop-helix (bHLH) proteins is involved in the determination of progenitor cells and, subsequently, in regulating neuronal differentiation. Here we report the identification of a novel subfamily of bHLH proteins, defined by two mammalian enhancer-of-split- and hairy-related proteins, termed Sharp-1 and Sharp-2. In contrast to known bHLH genes, detectable transcription of Sharp genes begins at the end of embryonic development marking differentiated neurons that have reached a final position, and increases as postnatal development proceeds. In the adult, Sharp genes are expressed in subregions of the CNS that have been associated with adult plasticity. In PC12 cells, a model system to study neurite outgrowth, Sharp genes can be induced by NGF with the kinetics of an immediate-early gene. Similarly, within 1 h after the administration of kalnic acid in vivo, Sharp-2 is induced in neurons throughout the rat cerebral cortex. This suggests that neuronal bHLH proteins are also involved in the "adaptive" changes of mature CNS neurons which are coupled to glutamatergic stimulation. PMID: 9532582, UI: 98193761

The Sharp-1 disclosed in this invention is expressed in at least the following tissues: Brain, Kidney, Lung, Prostate, SeqCalling_diseasestates: squamous cell carcinoma fetal lung NbHL19W, testis NHT, and B-cell kidney. This information was derived by determining the tissue sources of the sequences that were included in the invention. SeqCalling sources: Brain, Kidney, Lung, Prostate, PublicEST sources: squamous cell carcinoma fetal lung NbHL19W, testis NHT, and B-cell kidney. In addition, the sequence is predicted to be expressed in the following tissues because of the expression pattern of (GenBank-ID: gb:GenBank-ID:AF009329| acc:AF009329) a closely related {Rattus norvegicus enhancer-of-split and hairy-related protein 1 (Sharp-1) mRNA, complete cds homolog in species Rattus norvegicus :fetal lung NbHL19W, testis NHT, and B-cell kidney.

The structural similarities indicate that NOV5 may function as a member of SHARP-1 family proteins. Accordingly, the NOV5 nucleic acids and proteins identified here may be useful in potential therapeutic applications implicated in (but not limited to) various pathologies and disorders as indicated herein. For example, a cDNA encoding the SHARP-1-like protein NOV5 may be useful in gene therapy, and the SHARP-1-like protein NOV5 may be useful when administered to a subject in need thereof. The NOV5 nucleic acid encoding SHARP-1-like protein, and the SHARP-1-like protein of the invention, or fragments thereof, may further be useful in diagnostic applications, wherein the presence or amount of the nucleic acid or the protein are to be assessed. Additional disease indications and tissue expression for NOV5 and NOV5 variants, if available, are presented in the Examples.

Based on the tissues in which NOV5 is most highly expressed, specific uses include developing products for the diagnosis or treatment of a variety of diseases and disorders associated therewith. Specific expression of NOV5 in normal and diseased tissues are shown in the Examples.

NOV5 nucleic acids and polypeptides are further useful in the generation of antibodies that bind immuno-specifically to the novel NOV5 substances for use in therapeutic or diagnostic methods. These antibodies may be generated according to methods known in the art, using prediction from hydrophobicity charts, as described in the "Anti-NOVX Antibodies" section below. The disclosed NOV5 protein has multiple hydrophilic regions, each of which can be used as an immunogen. In one embodiment, a contemplated NOV5 epitope is from about amino acids 1 to 100. In another embodiment, a NOV5 epitope is from about amino acids 105 to 190. In additional embodiments, NOV5 epitopes are from about amino acids 200 to 360, from about amino acids 375 to 455, from about amino acids 460 to 580, from about amino acids 640 to 670, and from about amino acids 710 to 767. These novel proteins can be used in assay systems for functional analysis of various human disorders, which will help in understanding of pathology of the disease and development of new drug targets for various disorders.

NOV6

A disclosed NOV6 nucleic acid (SEQ ID NO:11) of 1702 nucleotides (also referred to as GSAC023158.15_A) encoding a novel SynaptotagminX-like protein is shown in Table 6A. An open reading frame was identified beginning with an ATG initiation codon at nucleotides 78–80 and ending with a TAA codon at nucleotides 1647–1649. Putative untranslated regions are found upstream from the initiation codon and downstream from the termination codon, and are underlined. The start and stop codons are shown in bold letters in Table 6A.

TABLE 6A

NOV6 nucleotide sequence (SEQ ID NO:11).

<u>CAGACGGGTTAGAGGTACGGGAAGAGGAAAAGACGGCTAACTGGGAAAAAAAGAGAAAACGAAAGAAAAG</u>

<u>CCAAACG</u>ATGAGTTTCCACAAGGAGGACGGAGTGAACAGTCTGTGCCAGAAGGCTCTGCACATCGTCACC

GAGCTGTGCTTCGCCCGCCAGGTGGAGTCGGAGAAGTGCTCGGGCATCTTCCCTCGGGACAGGGGCAGCC

AGGGCGGAAGCAGCACAGATATTTCAGTCAGCCTGTTAGCTGTCGTTGTCAGCTTTTGTGGACTGGCCTT

GTTGGTTGTCTCACTTTTTGTCTTCTGGAAGCTGTGTTGGCCATGCTGGAAAAGCAAACCTGTGACTTCC

AACATCACTACGCTTCCACAGAGCATTTCAAGTGCTCCTACTGAAGTTTTTGAGACTGAAGAGAAAAAAG

AAATTAAGGAAAATGAAAAGCCAGCCGTAAAAGCTATTGAGCCTGCAATAAAAATCAGCCACACTTCCCC

TGACATCCCAGCAGAAGTCCAAACTGCTTTAAAAGAACATTTAATTAAACATGCACGTGTGCAAAGACAA

ATTACTGAGCCTACGTCATCAACCCGGCACAGTTCCTTCCGAAGACACCTGCCGAGGCAAATGCAGGTTT

CCAGTGTTGATTTTAGCATGGGCACAGAACCTGTTTTACAACGAGGAGAAACAACAACCAGCATTGGGAG

TGTGGGAAACTTAACTTTACCCTCCAGTATGATTATGAAAATGAACTTCTAGTTGTTAAAATTATCAAAG

CTTTAGATCTCCCTGCTAAAGACTTCACAGGAACTTCTGACCCTTATGTGAACATGTATCTTCTTCCAGA

TAGGAAAAAGAAATTTCAGACCCGCGTGCACAGAAAGACTTTAAATCCTCTATTTGATGAAACTTTTCAA

TTTCCTGTAGCATATGATCAACTAAGCAACCGAAAACTACATTTCAGTGTGTATGATTTTGACAGATTTT

CTAGACATGACATGATTGGGGAAGTGATTCTTGATAATTTGTTTGAAGTCTCTGATCTCTCCAGGGAAGC

CACAGTATGGAAAOATATTCACTGTGCTACCACAGAAAGTATAGACCTGGGTGAAATCATGTTTTCCCTT

TGTTACCTACCGACGGCTGGGCGTATGACATTGACAGTCATTAAGTGCAGAAATCTGAAGGCGATGGATA

AACAACTACAAAGAAAAACACTCTAAACCCTGTGTACAATGAGGCCATTATTTTTGACATCCCTCCAGAG

AACGTGGACCAGGTCAGCCTCTCCATTGCGGTCATGGATTACGATAGGGTAGGACACAATGAGGTCATAG

GAGTGTGCAGAACAGGACTGGATGCTGAGGGTCTTGGGCGAGACCACTGGAATGAAATGCTGGCCTATCA

TABLE 6A-continued

NOV6 nucleotide sequence (SEQ ID NO:11).

TCGAAAACCAATAACGCACTGGCACCCATTGCTGGAGTTACCTGGCCGGGCGACCAGTTTTGATAGTCAA

GGATCCTGCCCTTCTCCTAAACCACCTTCCACACCATAATGCCTCCAAAATGAGACCATGATATTAAGCA

TCTAGGATCACGTGCTCATTGA

A disclosed NOV6 polypeptide (SEQ ID NO:12) encoded by SEQ ID NO:11 has 523 amino acid residues and is presented in Table 6B using the one-letter amino acid code. In one embodiment, NOV6 is a Type Ib (Nexo Ccyt) membrane protein, with a predicted INTEGRAL Likelihood of −11.36 [Transmembrane 59–75 (48–84)]. SignalP, Psort and/or Hydropathy results predict that NOV6 has a signal peptide and is likely to be localized endoplasmic reticulum (membrane) with a certainty of 0.6000. In an alternative embodiment, NOV6 is likely to be localized to the plasma membrane with a certainty of 0.4600, or to the nucleus with a certainty of 0.3000, or to the mitochondrial inner membrane with a certainty of 0.1000. The most likely cleavage site for a NOV6 peptide is between amino acids 31 and 32, i.e., at the dash between amino acids VEW-EK. NOV6 has a molecular weight of 59123.72 Daltons.

TABLE 6B

Encoded NOV6 protein sequence (SEQ ID NO:12).

MSFHKEDGVNSLCQKALHIVTELCFAGQVEWEKCSGIFPRDRGSQGGSSTDISVSLLAVVVSFCGLALLV

VSLFVFWKLCWPCWKSKPVTSNITTLPQSISSAPTEVFETEEKKEIKENEKPAVKAIEPAIKISHTSPDI

PAEVQTALKEHLIKHARVQRQITEPTSSTRHSSFRRHLPRQMQVSSVDFSMGTEPVLQRGETTTSIGRIK

PELYKQKSVDSEGNQNEDVKICGKLNFTLQYDYENELLVVKIIKALDLPAKDFTGTSDPYVKMYLLPDRK

KKFQTRVHRKTLNPLFDETFQFPVAYDQLSNRKLHFSVYDFDRFSRHDMIGEVILDNLFEVSDLSREATV

WKDIHCATTESIDLGEIMFSLCYLPTAGRMTLTVIKCRNLKAMDITGSSDPYVKVSLMCEGRRLKKRKTT

TKKNTLNPVYNEAIIFDIPPENVDQVSLSIAVMDYDRVGHNEVIGVCRTGLDAEGLGRDHNNEMLAYHRK

PITHWHPLLELPGRATSFDSQGSCPSPKPPSTP

Genomic clone(s) NOV6 GSAC023158.15_A on chromosome chromosome 12 were identified by TBLASTN using proprietary sequence file for members of Ras-Related protein and/or Ras-Related protein family, run against the genomic daily files made available by GenBank or obtained from Human Genome Project Sequencing centers, and further analyzed as described for NOV1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database that contains sequences published in patents and patent publications. Patp results include those listed in Table 6C.

TABLE 6C

Patp BLASTP Analysis for NOV6

| Sequences producing High-scoring Segment Pairs | Protein/Organism | Length (aa) | Identity (%) | Positive (%) | E Value |
|---|---|---|---|---|---|
| patp: AAR97722 | Mouse inositol polyphosphate binding protein IP4-BP - *Mus musculus* | 422 | 136/279 (48%) | 193/279 (69%) | 2.0e−72 |
| patp: AAW74584 | Repro-PC-1.0 prostate cancer-specific marker - *Homo sapiens* | 425 | 133/316 (42%) | 191/316 (60%) | 2.5e−56 |
| patp: AAW75782 | Hormone-regulated Repro-PC-1.0 polypeptide - *Homo sapiens* | 425 | 133/316 (42%) | 191/316 (60%) | 2.5e−56 |
| patp: AAM39577 | Human polypeptide clone no 2722 - *Homo sapiens* | 431 | 125/288 (43%) | 177/288 (61%) | 3.7e−55 |

TABLE 6C-continued

Patp BLASTP Analysis for NOV6

| Sequences producing High-scoring Segment Pairs | Protein/Organism | Length (aa) | Identity (%) | Positive (%) | E Value |
|---|---|---|---|---|---|
| patp: AAM93420 | Human polypeptide, clone no: 3040 - *Homo sapiens* | 431 | 125/288 (43%) | 177/288 (61%) | 3.7e-55 |

In a search of sequence databases, it was found, for example, that the nucleic acid sequence of this invention has 1415 of 1626 bases (87%) identical to a gb:GenBank-ID:AB026807 | acc:AB026807 mRNA from *Mus musculus* (*Mus musculus* mRNA for synaptotagmin X, complete cds). The full amino acid sequence of the protein of the invention was found to have 486 of 523 amino acid residues (92%) identical to, and 502 of 523. amino acid residues (95%) similar to, the 523 amino acid residue ptnr:SptrEmbl-ACC:Q9R0N4 protein from *Mus musculus* (SynaptotagminX).

In a further search of public sequence databases, NOV6 was found to have homology to the amino acid sequences shown in the BLASTP data listed in Table 6D.

TABLE 6D

BLASTP results for NOV6

| Gene Index/ Identifier | Protein/Organism | Length (aa) | Identity (%) | Positives (%) | Expect |
|---|---|---|---|---|---|
| gi\|14210268\| gb\|AAK56958.1\| AF375463_1 AF375463 | synaptotagmin 10 [*Rattus norvegicus*] | 523 | 488/523 (93%) | 503/523 (95%) | 0.0 |
| gi\|9055358\| ref\|NP_061273.1\| NM_018803 | synaptotagmin 10 [*Mus musculus*] | 523 | 486/523 (92%) | 502/523 (95%) | 0.0 |
| gi\|7441534\| pir\|\|PC6300 | synaptotagmin X —rat (fragment) | 498 | 463/498 (92%) | 478/498 (95%) | 0.0 |
| gi\|9055362\| ref\|NP_061270.1\| NM_018800 | synaptotagmin 6 [*Mus musculus*] | 511 | 330/496 (66%) | 392/496 (78%) | 0.0 |
| gi\|11559958\| ref\|NP_071527.1\| NM_022191 | synaptotagmin 6 [*Rattus norvegicus*] | 511 | 327/496 (65%) | 387/496 (77%) | 0.0 |

The homology of these and other sequences is shown graphically in the ClustalW analysis shown in Table 6E. The NOV6 polypeptide is provided in lane 1.

TABLE 6E

ClustalW Analysis of NOV6

1) Novel NOV6 (SEQ ID NO:12)
2) gi|14210268 (SEQ ID NO:78)
3) gi|9055358 (SEQ ID NO:79)
4) gi|7441534 (SEQ ID NO:80)
5) gi|9055362 (SEQ ID NO:81)
6) gi|11559958 (SEQ ID NO:82)

```
                              10        20        30        40        50
                     ....|....|....|....|....|....|....|....|....|....|
NOV6 GSAC023158.15_A  MSFHKEDGVNSLCQKALHIVTELCFAGQVEWEKCSGIFPRDRGSQGGSST
          gi|14210268 MSFRKEDGVSSLCQKALHITTELCFAGQVEWDKCSGIFPADRSGQGGGGT
          gi|9055358  MSFRKEDGVSSLCQKALHITTELCFAGQVEWEKCSGIFPADRSGQGGGGT
          gi|7441534  MSFRKEDGVSSLCQKALHITTELCFAGQVEWDKCSGIFPADRSGQGGGGT
          gi|9055362  MSGVWGAGGPRCQAALAVLASLCRARPPPLGLDVETCRSFELQSPEQSPS
          gi|11559958 MSGVWGAGGPRCQAALAVLASLCRARPPPLGLDVETCRSFELQSPEQSPS
```

TABLE 6E-continued

ClustalW Analysis of NOV6

```
                            60         70         80         90        100
                   ....|....|....|....|....|....|....|....|....|....|
NOV6 GSAC023158.15_A DISVSLLAVVVSFCGLALLVVSLFVFWKLCWPCWKSKPVTSNITTLPQSI
gi|14210268|         DISVSLLAVVVSFCGLALLVVSLFVFWKLCWPCWKSKLVAPNVSLLPQSI
gi|9055358           DISVSLLAVVVSFCGLALLVVSLFVFWKLCWPCWKSKLVAPNLSVLPQSI
gi|7441534           DISVSLLAVVVSFCGLALLVVSLFVFWKLCWPCWKSKLVAPNVSTLPQSI
gi|9055362           AADSGTSVSLLAVVVIVCGVALVAVFLFLFWKLCWMPWRKKEASSPSSAN
gi|11559958          AADSGTSVSLLAVVVIVCGVALVAVFFFLFWKLCWMPWRKKEASSPSSAN 110        120        130        140        150
                   ....|....|....|....|....|....|....|....|....|....|
NOV6 GSAC023158.15_A SSAPTEVFETEEKKEIKENEKPAVKAIEPAIKISHTSPDIPAEVQTALKE
gi|14210268|         SSAPTEVFETEEKKEVEENEKPAPKAIEPAIKISHTSPDIPAEVQTALKE
gi|9055358           SSAPTEVFETEEKKEVEENEKPAPKAIEPAIKISHTSPDIPAEVQTALKE
gi|7441534           SSAPTEVFETEEKKEVEENEKPAPKAIEPAIKISHTSPDIPAEVQTALKE
gi|9055362           PASEILQSPSSRGNMADKLKDPSALGFLEAAVKISHTSPDIPAEVQMSVK
gi|11559958          PASEILQSPSSRGNMADKLKDPSALGFLEAAVKISHTSPDIPAEVQMSVK 160        170        180        190        200
                   ....|....|....|....|....|....|....|....|....|....|
NOV6 GSAC023158.15_A HLIKHARVQRQITEPTSSTRHSSFRRHLPRQMQVSSVDFSMGTEPVLQRG
gi|14210268|         HLIKHARVQRQTTDPTSSSRHNSFRRHLPRQMNVSSVDFSMGTEPVLQRG
gi|9055358           HLIKHARVQRQTTEPTSSSRHNSFRRHLPRQMNVSSVDFSVGTEPILQRG
gi|7441534           HLIKHARVQRQTTEPTSSSRHNSFRRHLPRQMNVSSVDFSMGTEPVLQRG
gi|9055362           EHIMRHTKLQRQTTEPASSTRHTSFKRHLPRQMHVSSVDYGNELPPAAAE
gi|11559958          EHIMRHTKLQRQTTEPASSTRHTSFKRHLPRQMHVSSVDYGNELPPAAAE 210        220        230        240        250
                   ....|....|....|....|....|....|....|....|....|....|
NOV6 GSAC023158.15_A ETTTSIGRIKPELYKQKSVDSEGNQNEDVKICGKLNFTLQYDYENELLVV
gi|14210268|         ETRTSIGRIKPELYKQKSVDSEGNRKDDVKTCGKLNFALQYDYENELLVV
gi|9055358           ETRTSIGRIKPELYKQKSVDSEGNRKDDVKTCGKLNFALQYDYENELLVV
gi|7441534           ETRTSIGRIKPELYKQKSVDSEGNRKDDVKTCGKLNFALQYDYENELLVV
gi|9055362           QPTSIGRIKPELYKQKSVDGDDAKSEAAKSCGKINFSLRYDYESETLIVR
gi|11559958          QPTSIGRIKPELYKQKSVDGDEAKSEAAKSCGKINFSLRYDYESETLIVR 260        270        280        290        300
                   ....|....|....|....|....|....|....|....|....|....|
NOV6 GSAC023158.15_A KIIKALDLPAKDFTGTSDPYVKMYLLPDRKKKFQTRVHRKTLNPLFDETF
gi|14210268|         KIIKALDLPAKDFTGTSDPYVKIYLLPDRKKKFQTRVHRKTLNPLFDELF
gi|9055358           KIIKALDLPAKDFTGTSDPYVKIYLLPDRKKKFQTRVHRKTLNPLFDELF
gi|7441534           KIIKALDLPAKDSTGTSDPYVKIYLLPDRKKKFQTRVHRKTLNPLFDELF
gi|9055362           ILKAFDLPAKDFCGSSDPYVKIYLPDRCKLQTRVHRKTLNPTFDENFH
gi|11559958          ILKAFDLPAKDFCGSSDPYVKIYLPDRCKLQTRVHRKTLNPTFDENFH 310        320        330        340        350
                   ....|....|....|....|....|....|....|....|....|....|
NOV6 GSAC023158.15_A QFPVAYDQLSNRKLHFSVYDFDRFSRHDMIGEVILDNLFEVSDLSREATV
gi|14210268|         QFPVVYDQLSNRKLHFSIYDFDRFSRHDMIGEVILDNLFEVSDLSREATV
gi|9055358           QFPVVYDQLSNRKLHFSIYDFDRFSRHDMIGEVILDNLFEVSDLSREATV
gi|7441534           QFPVVYDQLSNRKLHFSIYDFDRFSRHDMIGEVILDNLFEVSDLSREATV
gi|9055362           FPVPYEELADRKLHLSVFDFDRFSRHDMIGEVILDNLFEASDLSRETSIW
gi|11559958          FPVPYEELADRKLHLSVFDFDRFSRHDMIGEVILDNLFEASDLSRETSIW 360        370        380        390        400
                   ....|....|....|....|....|....|....|....|....|....|
NOV6 GSAC023158.15_A WKDIHCATTESIDLGEIMFSLCYLPTAGRMTLTVIKCRNLKAMDITGSSD
gi|14210268|         WKDIHCATTESIDLGEIMFSLCYLPTAGRMTLTVIKCRNLKAMDITGSSD
gi|9055358           WKDIHCATTESIDLGEIMFSLCYLPTAGRMTLTVIKCRNLKAMDITGSSD
gi|7441534           WKDIHCATTESMDLGEIMFSLCYLPTAGRMTLTVIKCRNLKAMDITGSSD
gi|9055362           KDIQYATSESVDLGEIMFSLCYLPTAGRLTLTVIKCRNLKAMDITGYSDP
gi|11559958          KDIQYATSESVDLGEIMFSLCYLPTAGRLTLTVIKCRNLKAMDITGYSDP 410        420        430        440        450
                   ....|....|....|....|....|....|....|....|....|....|
NOV6 GSAC023158.15_A PYVKVSLMCEGRRLKKRKTTTKKNTLNPVYNEAIIFDIPPENVDQVSLSI
gi|14210268|         PYVKVSLMCEGRRLKKRKTTTKKNTLNPVYNEAIIFDIPPENVDQVSLCI
gi|9055358           PYVKVSLMCEGRRLKKRKTTTKKNTLNPVYNEAIIFDIPPENVDQVSLCI
gi|7441534           PYVKVSLMCEGRRLKKRKTTTKKNTLNPVYNEAIIFDIPPENVDQVSLCI
gi|9055362           YVKVSLLCDGRRLKKKKTTIKKNTLNPVYNEAIIFDIPPENMDQVSLLIS
gi|11559958          YVKVSLLCDGRRLKKKKTTIKKNTLNPVYNEAIIFDIPPENMDQVSLLIS 460        470        480        490        500
                   ....|....|....|....|....|....|....|....|....|....|
NOV6 GSAC023158.15_A AVMDYDRVGHNEVIGVCRTGLDAEGLGRDHWNEMLAYHRKPITHWHPLLE
gi|14210268|         AVMDYDRVGHNEVIGVCRTGLDAEGLGRDHWNEMLAYHRKPITHWHPLLE
gi|9055358           AVMDYDRVGHNEVIGVCRTGLDAEGLGRDHWNEMLAYHRKPITHWHPLLE
gi|7441534           AVMDYDRVGHNEVIGVCRTGLDAEGLGRDHWNEMLAYHRKPITHWHPL
gi|9055362           VMDYDRVGHNEIIGVCRVGINAEGLGRDHWNEMLAYPRKPIAHWHSLVEV
gi|11559958          VMDYDRVGHNEIIGVCRVGISAEGLGRDHWNEMLAYPRKPIAHWHCLAEV
```

TABLE 6E-continued

ClustalW Analysis of NOV6

```
                              510        520
                         ....|....|....|....|...
NOV6 GSAC023158.15_A     LPGRATSFDSQGSCPSPKPPSTP
gi|14210268|             LPGRATSFDSQGSCPSPKPPSTP
gi|9055358|              LPGRATSFDSQGSCPSPKPPSTP
gi|7441534|
gi|9055362|                     KKSFKEGTPRL
gi|11559958|                    KKSFKEGTPRL
```

The presence of identifiable domains in NOV6 was determined as described in NOV1. Table 6F lists the domain description from DOMAIN analysis results against NOV6. The NOV6 protein contains the following protein domains (as defined by Interpro) at the indicated nucleotide positions: domain name C2 domain at amino acid positions 248 to 334, domain name C2 domain at amino acid positions 380 to 468, etc. This indicates that the sequence of the invention has properties similar to those of other proteins known to contain this/these domain(s) and similar to the properties of these domains.

TABLE 6F

Domain Analysis of NOV6

| PSSMs producing significant alignments: | | | Score (bits) | Evalue |
|---|---|---|---|---|
| gnl|Pfam|pfam00168 | C2, | C2 domain | 102 | 5e–23 |
| gnl|Pfam|pfam00168 | C2, | C2 domain | 73.2 | 4e–14 |
| gnl|Smart|smart00239 | C2, | Protein kinase C conserved region 2 (CalB); | 99.4 | 5e–22 |
| gnl|Smart|smart00239 | C2, | Protein kinase C conserved region 2 (CalB) | 63.5 | 3e–11 | gnl|Pfam|pfam00168, C2, C2 domain. CD-Length = 88 residues, 100.0% aligned
gnl|Pfam|pfam00168, C2, C2 domain. CD-Length = 88 residues, 98.9% aligned
gnl|Smart|smart00239, C2, Protein kinase C conserved region 2 (CalB); Ca2+-binding motif present in phospholipases, protein kinases C, and synaptotamins (among others). Some do not appear to contain Ca2+-binding sites. Particular C2s appear to bind phospholipids, inositol polyphosphates, and intracellular proteins. Unusual occurrence in perforin. Synaptotagmin and PLC C2s are permuted in sequence with respect to N- and C-terminal beta strands. SMART detects C2 domains using one or both of two profiles. CD-Length = 101 residues, 87.1% aligned
gnl|Smart|smart00239, C2, Protein kinase C conserved region 2 (CalB); Ca2+-binding motif present in phospholipases, protein kinases C, and synaptotamins (among others). Some do not appear to contain Ca2+-binding sites. Particular C2s appear to bind phospholipids, inositol polyphosphates, and intracellular proteins. Unusual occurrence in perforin. Synaptotagmin and PLC C2s are permuted in sequence with respect to N- and C-terminal beta strands. SMART detects C2 domains using one or both of two profiles. CD-Length = 101 residues, 89.1% aligned The disclosed NOV6 nucleic acid encoding a SynaptotagminX-like protein includes the nucleic acid whose sequence is provided in Table 6A, or variant thereof, including a SNP, fragment, homology, analog of the sequence is provided in Table 6A. The invention also includes a mutant or variant nucleic acid any of whose bases may be changed from the corresponding base shown in Table 6A while still encoding a protein that maintains its SynaptotagminX-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 13% percent of the bases may be so changed.

The disclosed NOV6 protein of the invention includes the SynaptotagminX-like protein whose sequence is provided in Table 6B. The invention also includes a mutant or variant protein any of whose residues may be changed from the corresponding residue shown in Table 6B while still encoding a protein that maintains its SynaptotagminX-like activities and physiological functions, or a functional fragment thereof. In the mutant or variant protein, up to about 8% percent of the residues may be so changed.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The SynaptotagminX-like sequence is predicted to be expressed in the following tissues because of the expression pattern of (GenBank-ID: AB026807|acc:AB026807 ) a closely related {*Mus musculus* mRNA for synaptotagmin X, complete cds homolog in species *Mus musculus*: brain.

The protein similarity information, expression pattern, and map location for the SynaptotagminX-like-like protein and nucleic acid disclosed herein suggest that this SynaptotagminX-like may have important structural and/or physiological functions characteristic of the synaptotagmin family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostoeodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

The structural similarities indicate that NOV6 may function as a member of SynaptotagminX family proteins. Accordingly, the NOV6 nucleic acids and proteins identified here may be useful in potential therapeutic applications implicated in (but not limited to) various pathologies and disorders as indicated herein. For example, a cDNA encoding the SynaptotagminX-like protein NOV6 may be useful in gene therapy, and the SynaptotagminX-like protein NOV6 may be useful when administered to a subject in need thereof. The NOV6 nucleic acid encoding SynaptotagminX-like protein, and the SynaptotagminX-like protein of the invention, or fragments thereof, may further be useful in diagnostic applications, wherein the presence or amount of the nucleic acid or the protein are to be assessed. Additional disease indications and tissue expression for NOV6 and NOV6 variants, if available, are presented in the Examples.

Based on the tissues in which NOV6 is most highly expressed, specific uses include developing products for the diagnosis or treatment of a variety of diseases and disorders associated therewith. Specific expression of NOV6 in normal and diseased tissues are shown in the Examples.

NOV6 nucleic acids and polypeptides are further useful in the generation of antibodies that bind immuno-specifically to the novel NOV6 substances for use in therapeutic or diagnostic methods. These antibodies may be generated according to methods known in the art, using prediction from hydrophobicity charts, as described in the "Anti-NOVX Antibodies" section below. The disclosed NOV6 protein has multiple hydrophilic regions, each of which can be used as an immunogen. In one embodiment, a contemplated NOV6 epitope is from about amino acids 1 to 20. In another embodiment, a NOV6 epitope is from about amino acids 30 to 55. In additional embodiments, NOV6 epitopes are from about amino acids 75 to 245, from about amino acids 250 to 335, from about amino acids 340 to 360, from about amino acids 390 to 440, and from about amino acids 445 to 523. These novel proteins can be used in assay systems for functional analysis of various human disorders, which will help in understanding of pathology of the disease and development of new drug targets for various disorders.

NOV7

A disclosed NOV7 nucleic acid (SEQ ID NO:13) of 1611 nucleotides (also referred to as GSAC055715_A) encoding a novel Type II Cytokeratin-like protein is shown in Table 7A. An open reading frame was identified beginning with an ATG initiation codon at nucleotides 1–3 and ending with a TAG codon at nucleotides 1609–1611. Putative untranslated regions are contemplated upstream from the initiation codon and downstream from the termination codon. The start and stop codons are shown in bold letters in Table 7A.

TABLE 7A

NOV7 nucleotide sequence (SEQ ID NO:13).

ATGAGTCGGCAACTGAACATCAAGTCCAGTGGTGACAAGGGCAACTTCAGTGTGCATTCGGCAGTGGTGC

CAAGGAAGGCTGTGGGTAGCCTGGCTTCTTACTGTGCAGCTGGCAGAGGGGCTGGCGCTGGCTTTGGCAG

TCGGAGCCTCTATAGCCTTGGAGGGAATCGGCGTATTTCTTTCAATGTGGCTGGTGGCGGCGTTCGGGCT

GGAGGTTACGGCTTCAGGCCTGGCTCTGGGTATGGAGGGGCCGGGCCAGTGGCTTTGCTGGCAGTATGT

TTGGCAGTGTGGCCCTGGGGCCTGCATGTTTGTCTGTGTGCCCACCTGGGGCATCCACCAGGTCACTGT

CAACAAGAGCCTCTTGGCCCCCCTCAACGTGGAGCTGGACCCTGAGATCCAGAAGGTGCGCGCCCAGGAG

CGGGAACAGATCAAGGTGCTGAACGACAAGTTCGCCTCCTTCATTGACAAGGTACGCTTCCTAGAGCAGC

AGAACCAGGTTCTAGAAACCAAGTGGGAGCTGCTGCAGCAGCTGGACCTGAACAACTGCAAGAAGAACCT

GGAGCCCATCCTTGAGGGCTACATCAGCAACCTGCGGAAGCAGCTGGAGACACTGTCTGGGGACAGGGTG

AGGCTGGACTCGGAGCTGAGAAGCATGAGGGATCTGGTGGAGGACTATAAGAAGAGATATGAAGTGGAGA

TTAACCGGCGCACGACAGCAGAGAATGAGTTTGTGGTGCTTAAGAAGGATGCAGATGCAGCCTACGCAGT

CAAGGTGGAGCTTCAGGCCAAAGTGGACTCACTGGACAAAGAAATCAAGTTCCTCAAGTGTCTGTATGAT

GCAGAGATCGCTCAGATCCAGACTCACGCCAGTGAGACCTCTGTCATCCTGTCCATGGACAACAACCGGG

ACCTGGACCTTGACAGCATCATCGCTGAGGTCCGCATGCATTATGAGGAGATCGCCCTGAAGAGCAAGGC

CGAGGCCGAGGCCCTGTACCAGACCAAGTTCCTATCTCTGGGAAACCAGATCCAGGAGCTGCAGCTGGCA

TABLE 7A-continued

NOV7 nucleotide sequence (SEQ ID NO:13).

```
GCCAGTCGGCATGGTGACGACCTGAAACACACCAGGAGCGAGATGGTGGAGCTGAACCGGCTCATCCAGA

GGATCCGGTGTGAGATCGGGAATGTGAAGAAGCAGCGTGCCAGCCTGGAGACGGCCATCGCTGACGCTGA

GCAGCGGGGAGACAATGCCCTGAAGGATGCCCAGGCCAACCTGGATGAGCTGGAGGGCCCCCTGCACCAG

GCCAAGGAGGAGCTGGCCCGGATGCTGCGCGAGTACCAGGAGCTCATGAGCCTGAAACTGGCCCTGGACA

TGGAGATTGCCACCTACCGCAAGCTGCTGGAGGGCGAGGAGTGCAGGATGTCTGGTGAGAATCCATCCTC

TGTGAGCATCTCTGTCATCAGCAGTAGCAGCTACAGCTACCACCACCCCAGCTCTGCGGGTGTTGACCTT

GGGGCCAGCGCTGTGGCAGGCAGCTCTGGCAGCACCCAGAGCGGGCAGACCAAGACCACAGAGGCGCGAG

GGGGAGACCTCAAGGACACCCAGGGCAAGAGCACCCCAGCCAGCATCCCAGCAAGGAAAGCCACCCGCTA

G
```

A disclosed NOV7 polypeptide (SEQ ID NO:14) encoded by SEQ ID NO:13 has 536 amino acid residues and is presented in Table 7B using the one-letter amino acid code. SignalP, Psort and/or Hydropathy results predict that NOV7 has no known signal peptide and is likely to be localized endoplasmic reticulum (membrane) with a certainty of 0.5500. In an alternative embodiment, NOV7 is likely to be localized to the lysosome (lumen) with a certainty of 0.1900, or to the endoplasmic reticulum (lumen) with a certainty of 0.1000, or to the outside the cell with a certainty of 0.1000. NOV7 has a molecular weight of 58622.06 Daltons.

sequence file for members of Ras-Related protein and/or Ras-Related protein family, run against the genomic daily files made available by GenBank or obtained from Human Genome Project Sequencing centers, and further analyzed as described for NOV1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database that contains

TABLE 7B

Encoded NOV7 protein sequence (SEQ ID NO:14).

```
MSRQLNIKSSGDKGNFSVHSAVVPRKAVGSLASYCAAGRGAGAGFGSRSLYSLGGNRRISFNVAGGGVRAGGYGFRPGSG

YGGGRASGFAGSMFGSVALGPACLSVCPPGGIHQVTVNKSLLAPLNVELDPEIQKVRAQEREQIKVLNDKFASFIDKVRF

LEQQNQVLETKWELLQQLDLNNCKKNLEPILEGYISNLRKQLETLSGDRVRLDSELRSMRDLVEDYKKRYEVEINRRTTA

ENEFVVLKKDADAAYAVKVELQAKVDSLDKEIKFLKCLYDAEIAQIQTHASETSVILSMDNNRDLDLDSIIAEVRMHYEE

IALKSKAEAEALYQTKFLSLGNQIQELQLAASRHGDDLKHTRSEMVELNRLIQRIRCEIGNVKKQRASLETAIADAEQRG

DNALKDAQAKLDELEGALHQAKEELARMLREYQELMSLKLALDMEIATYRKLLEGEECRMSGENPSSVSISVISSSSYSY

HHPSSAGVDLGASAVAGSSGSTQSGQTKTTEARGGDLKDTQGKSTPASIPARKATR
```

Genomic clones NOV7 GSAC055715_A on chromosome 12 were identified by TBLASTN using proprietary sequences published in patents and patent publications. Patp results include those listed in Table 7C.

TABLE 7C

Patp BLASTP Analysis for NOV7

| Sequences producing High-scoring Segment Pairs | Protein/Organism | Length (aa) | Identity (%) | Positive (%) | E Value |
|---|---|---|---|---|---|
| patp: AAY52398 | Human keratin KERT-2 - *Homo sapiens* | 551 | 301/532 (56%) | 394/532 (74%) | 2.8e−144 |
| patp: AAY52397 | Human keratin KERT-1 - *Homo sapiens* | 546 | 289/516 (56%) | 368/516 (71%) | 6.8e−134 |
| patp: AAB58755 | Breast and ovarian cancer associated antigen protein sequence clone no: 463 - *Homo sapiens* | 433 | 232/389 (59%) | 298/389 (76%) | 2.5e−113 |
| patp: AAW23820 | Human sarcolectin - *Homo sapiens* | 469 | 245/444 (55%) | 314/444 (70%) | 5.9e−112 |
| patp: AAY69289 | Amino acid sequence of a human sarcolectin (SCL) protein - *Homo sapiens* | 469 | 245/444 (55%) | 314/444 (70%) | 5.9e−112 |

In a search of sequence databases, it was found, for example, that the nucleic acid sequence of this invention has 664 of 781 bases (85%) identical to a gb: GenBank-ID:AB0337441|acc: AB033744 mRNA from *Mus musculus* (*Mus musculus* mRNA for type II cytokeratin, complete cds). The full amino acid sequence of the protein of the invention was found to have 346 of 456 amino acid residues (75%) identical to, and 391 of 456 amino acid residues (85%) similar to, the 524 amino acid residue ptnr: SptrEmbl-ACC: Q9R0H5 protein from *Mus musculus* (Type II Cytokeratin).

In a further search of public sequence databases, NOV7 was found to have homology to the amino acid sequences shown in the BLASTP data listed in Table 7D.

TABLE 7D

BLASTP results for NOV7

| Gene Index/Identifier | Protein/Organism | Length (aa) | Identity (%) | Positives (%) | Expect |
|---|---|---|---|---|---|
| gi|15321302| ref|XP_053295.1| XM_053295 | keratin 6 irs [*Homo sapiens*] | 523 | 393/541 (72%) | 437/541 (80%) | 0.0 |
| gi|9910294| ref|NP_064340.1| NM_019956 | keratin complex 2, gene 6 g [*Mus musculus*] | 524 | 375/540 (69%) | 424/540 (78%) | 0.0 |
| gi|15321300| ref|XP_053294.1| XM_053294 | hypothetical protein XP_053294 [*Homo sapiens*] | 441 | 343/448 (76%) | 379/448 (84%) | e−176 |
| gi|16209201| gb|AAL14196.1| AY043326 | keratin 4 [*Homo sapiens*] | 534 | 298/479 (62%) | 358/479 (74%) | e−144 |
| gi|547753| sp|P19013|K2C4 | HUMAN KERATIN, TYPE II CYTOSKELETAL 4 (CYTOKERATIN 4) (K4) (CK4) | 534 | 297/479 (62%) | 357/479 (74%) | e−142 |

The homology of these and other sequences is shown graphically in the ClustalW analysis shown in Table 7E. The NOV7 polypeptide is provided in lane 1.

TABLE 7E

ClustalW Analysis of NOV7

1) Novel NOV7 (SEQ ID NO:14)
2) gi|15321302 (SEQ ID NO:83)
3) gi|9910294 (SEQ ID NO:84)
4) gi|15321300 (SEQ ID NO:85)
5) gi|16209201 (SEQ ID NO:86)
6) gi|547753 (SEQ ID NO:87)

TABLE 7E-continued

ClustalW Analysis of NOV7

```
                       10         20         30         40         50
                ....|....|....|....|....|....|....|....|....|....|
NOV7 GSAC055715_A  MSRQLNIKSSGDKGNFSVHSAVVPRKAVGSLASYCAAGRGAGAGFGSRSL
gi|15321302|       MSRQFTCKSGAAAKGGFSGCSAVLSGGSSSSFRAGSKGLSGGFGSRSLYS
gi|9910294|        MSRQFTCKSGASNRGFSGCSAVLSGGSSSURAGGKGLSGGFGSRSLYSL
gi|15321300|       MFGSVALGPVCPTVCPPGGIHQVTVNESLLAPLNVELDPEIQKVRAQERE
gi|16209201|       MIARQQCVRGGPRGFSCGSAIVGGGKRGAFSSVSMSGGAGRCSSGGFGSR
gi|547753|         MIARQQCVRGGPRGFSCGSAIVGGGKRGAFSSVSMSGGAGRCSSGGFGSR 60         70         80         90        100
                ....|....|....|....|....|....|....|....|....|....|
NOV7 GSAC055715_A  YSLGGNRRISFNVAGGCVRAGGYGFRPGSGYGGGRASGFAGSMFGSVALG
gi|15321302|       LGGVRSLNVASGSGKSGGYGFGRGRASGFAGSMFGSVALGPVCPTVCPPG
gi|9910294|        GGGRSITLNMASGSGKNGGFGFGRNRASGFAGSIFGSVALGPVCPAVCPP
gi|15321300|       QIKALNNKFASFIDKVRFLEQQNQVLETKWELLQQLDLNNCKNNLEPILE
gi|16209201|       SLYNLRGNKSISMSVAGSRQGACFGGAGGFGTGGFGAGGFGAGFGTGGFG
gi|547753|         SLYNLRGNKSISMSVAGSRQGACFGGAGGFGTGGFGAGGFGAGFGTGGFG 110        120        130        140        150
                ....|....|....|....|....|....|....|....|....|....|
NOV7 GSAC055715_A  PACLSVCPPGGIHQVTVNKSLLAPLNVELDPEIQKVRAQEREQIKVLNDK
gi|15321302|       GIHQVTVNESLLAPLNVELDPEIQKVRAQEREQIKALNNKFASFIDKVRF
gi|9910294|        GGIHQVTVNESLLAPLNVELDPEIQKVRAQEREQIKALNNKFASFIDKVR
gi|15321300|       GYISNLRKQLETLSGDRVRLDSELRNVRDVVEDYKKRYEEEINKRTAAEN
gi|16209201|       GGFGGSFSGKGGPGFPVCPAGGIQEVTINQSLLTPLHVEIDPEIQKVRTE
gi|547753|         GGFGGSFSGKGGPGFPVCPAGGIQEVTINQSLLTPLHVEIDPEIQKVRTE 160        170        180        190        200
                ....|....|....|....|....|....|....|....|....|....|
NOV7 GSAC055715_A  FASFIDKVRFLEQQNQVLETKWELLQQLDLNNCKKNLFPILEGYISNLRK
gi|15321302|       LEQQNQVLETKWELLQQLDLNNCKNNLEPILEGYISNLRKQLETLSGDRV
gi|9910294|        FLEQQNQVLQTKWELLQQLDLNNCKNNLEPILEGHISNMRKQLETLSGDR
gi|15321300|       EFVLLKKDVDAAYANKVEIQAKVESMDQEIKFFRCLFEAEITQIQSHISD
gi|16209201|       EREQIKLLNNKFASFIDKVQFLEQQNKCLETKWNLLQQQTTTTSSKNLEP
gi|547753|         EREQIKLLNNKFASFIDKVQFLEQQNKCLETKWNLLQQQTTTTSSKNLEP 210        220        230        240        250
                ....|....|....|....|....|....|....|....|....|....|
NOV7 GSAC055715_A  QLETLSGDRVRLDSELRSMFDLVEDYKKRYEVEINRRTTAENFFVVLKKD
gi|15321302|       RLDSELRNVRDVVEDYKKRYEEEINRTAAENEFVLLKKDVDAAYANKVE
gi|9910294|        VRLDSELRNVRDVVEDYKKRYEEEINRTAAENEFVLLKKDVDAAYANKV
gi|15321300|       MSVILSMDNNRNLDLDSIIDEVRTQYEEIALKSKAEAEALYQTKFQELQL
gi|16209201|       LFETYLSVLRKQLDTLGNDKGRLQSELKTMQDSVEDFKTKYEEEINKPTA
gi|547753|         LFETYLSVLRKQLDTLGNDKGRLQSELKTMQDSVEDFKTKYEEEINKPTA 260        270        280        290        300
                ....|....|....|....|....|....|....|....|....|....|
NOV7 GSAC055715_A  ADAAYAVKVELQAKVDSLDKEIKFLKCLYDAEIAQIQTHASETSVILSMD
gi|15321302|       LQAKVESMDQEIKFFRCLFEAEITQIQSHISDMSVILSMDNNRNLDDSI
gi|9910294|        ELQAKVDTMDQDIKFFKCLFEAKMAQIQSHISDMSVILSMDNNRNLDLDS
gi|15321300|       AAGRHGDDLKNTKNEISELTRLIQRIRSEIENVKKQASNLETAIADAEQR
gi|16209201|       AENDFVVLKKDVDAAYLNKVELEAKVDSLNDEINFLKVLYDAELSQMQTH
gi|547753|         AENDFVVLKKDVDAAYLNKVELEAKVDSLNDEINFLKVLYDAELSQMQTH 310        320        330        340        350
                ....|....|....|....|....|....|....|....|....|....|
NOV7 GSAC055715_A  NNRDLDLDSIIAEVRMHYEEIALKSKAEAEALYQTKFLSLGNQIQELQLA
gi|15321302|       IDEVRTQYEEIALKSKAEAEALYQFQELQLAAGRHGDDLKNTKNEISE
gi|9910294|        IIDEVRAQYEEIALKSKAEAEALYQTKFQELQLAAGRHGDDLKNTKNEIT
gi|15321300|       GDNALKDARAKLDELEGALHQAKEELARMLREYQELMSLKLALDMEIATY
gi|16209201|       VSDTSVVLSMDNNRNLDLDSIIAEVRAQYEEIAQRSKAEAEALYQTKVQQ
gi|547753|         VSDTSVVLSMDNNRNLDLDSIIAEVRAQYEEIAQRSKAEAEALYQTKVQQ 360        370        380        390        400
                ....|....|....|....|....|....|....|....|....|....|
NOV7 GSAC055715_A  ASRHGDDLKHTRSEMVELNRLIQRIRCEIGNVKKQRASLETAIADAEQRG
gi|15321302|       LTRLIQRIRSEIENVKKQASNLETAIADAEQRGDNALKDARAKLDELEGA
gi|9910294|        ELTRFIQRLRSEIENAKKQASNLETAIADAEQRGDSALKDARAKLDELEG
gi|15321300|       RKLLESEECRMSGEFPSPVSISIISSTSGGSVYGFRPSMVSGGYVANSSN
gi|16209201|       LQISVDQHGDNLKNTKSEIAELNRMIQRLRAEIENIKKQCQTLQVSVADA
gi|547753|         LQISVDQHGDNLKNTKSEIAELNRMIQRLRAEIENIKKQCQTLQVSVADA 410        420        430        440        450
                ....|....|....|....|....|....|....|....|....|....|
NOV7 GSAC055715_A  DNALKDAQAKLDELEGALHQAKEELARMLREYQELMSLKLALDMEIATYR
gi|15321302|       LHQAKEELARMLREYQELMSLKLALDMEIATYRKLLESEECRMSGEFPSP
gi|9910294|        ALHQAKEELARMLREYQELMSLKLALDMEIATYRKLLESEECRMSGEYSS
gi|15321300|       CISGVCSVRGGEGRSRGSANDYKDTLGKGSSLSAPSKKTSR
gi|16209201|       EQRGENALKDAHSKRVELEAALQQAKEELARMLREYQELMSVKLALDIEI
gi|547753|         EQRGENALKDAHSKRVELEAALQQAKEELARMLREYQELMSVKLALDIEI
```

TABLE 7E-continued

ClustalW Analysis of NOV7

```
                    460        470        480        490        500
               ....|....|....|....|....|....|....|....|....|....|
NOV7 GSAC055715_A KLLEGEECRMSGENPSSVSISVISSSSYSYHHPSSAGVDLGASAVAGSSG
gi|15321302|      VSISIISSTSGGSVYGFRPSMVSGGYVANSSNCISGVCSVRGGEGRSRGS
gi|9910294|       PVSISIISSTSGSGGYGFRPSTVSGGYVANSTSCISGVCSVRGGENRSRG
gi|15321300|
gi|16209201|      ATYRKLLEGEEYRMSGECQSAVSISVVSGSTSTGGISGGLGSGSGFGLSS
gi|547753|        ATYRKLLEGEEYRMSGECQSAVSISVVSGSTSTGGISGGLGSGSGFGLSS 510        520        530
               ....|....|....|....|....|....|....|.
NOV7 GSAC055715_A STQSGQTKTTEARGGDLKDTQGKSTPASIPARKATR
gi|15321302|      ANDYKDTLGKGSSLSAPSKKTSR
gi|9910294|       SASNYKDTLTKGSSLSTPSKKGGR
gi|15321300|
gi|16209201|      GFGSGSGSGFGFGGSVSGSSSSKIISTTTLNKRR
gi|547753|        GFGSGSGSGFGFGGSVSGSSSSKIISTTTLNKRR
```

The presence of identifiable domains in NOV7 was determined as described in NOV1. The NOV7 protein contains the following protein domains (as defined by Interpro) at the indicated nucleotide positions: domain name K-box (IPR002487) at amino acid positions 236 to 333, domain name filament (IPR001664) at amino acid positions 59 to 379, etc. Table 7F lists the domain description from DOMAIN analysis results against NOV7. This indicates that the NOV7 sequence has properties similar to those of other proteins known to contain these domains.

TABLE 7F

Domain Analysis of NOV7

| PSSMs producing significant alignments: | | Score (bits) | Evalue |
|---|---|---|---|
| gnl\|Pfam\|pfam00038 | filament, Intermediate filament protein | 283 | 1e-77 |
| gnl\|Pfam\|pfam01496 | V_ATPase_sub_a, V-type ATPase 116 kDa subunit | 37.4 | 0.002 | gnl|Pfam|pfam00038, filament, Intermediate filament protein. CD-Length = 312 residues, 100.0% aligned
gnl|Pfam|pfam01496, V_ATPase_sub_a, V-type ATPase 116 kDa subunit family. This family consists of the 116 kDa V-type ATPase (vacuolar (H+)-ATPases) subunits, as well as V-type ATP synthase subunit i. The V-type ATPases family are proton pumps that acidify intracellular compartments in eukaryotic cells for example yeast central vacuoles, clathrin-coated and synaptic vesicles. They have important roles in membrane trafficking processes. The 116 kDa subunit (subunit a) in the V-type ATPase is part of the V0 functional domain responsible for proton transport. The a subunit is a transmembrane glycoprotein with multiple putative transmembrane helices it has a hydrophilic amino terminal and a hydrophobic carboxy terminal. It has roles in proton transport and assembly of the V-type ATPase complex. This subunit is encoded by two homologous gene in yeast VPH1 and STV1. CD-Length = 703 residues, only 28.3% aligned The disclosed NOV7 nucleic acid encoding a Type II Cytokeratin-like protein includes the nucleic acid whose sequence is provided in Table 7A, or variant thereof, including a SNP, fragment, homology, analog of the sequence is provided in Table 7A. The invention also includes a mutant or variant nucleic acid any of whose bases may be changed from the corresponding base shown in Table 7A while still encoding a protein that maintains its Type II Cytokeratin-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 15% percent of the bases may be so changed.

The disclosed NOV7 protein of the invention includes the Type II Cytokeratin-like protein whose sequence is provided in Table 7B. The invention also includes a mutant or variant protein any of whose residues may be changed from the corresponding residue shown in Table 7B while still encoding a protein that maintains its Type II Cytokeratin-like activities and physiological functions, or a functional fragment thereof. In the mutant or variant protein, up to about 25% percent of the residues may be so changed.

The invention further encompasses antibodies and antibody fragments, such as $F_{ab}$ or $(F_{ab})_2$ that bind immunospecifically to any of the proteins of the invention. Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The Type II Cytokeratin disclosed in this invention is expressed in at least the following tissues: skin, muscle, bone, cartilage, Colon carcinoma, lung. This information was derived by determining the tissue sources of the sequences that were included in the invention., PublicEST sources:: skin, muscle, bone, cartilage, Colon carcinoma, lung. In addition, the sequence is predicted to be expressed in the following tissues because of the expression pattern of (GenBank-ID: gb: GenBank-ID: AB033744|acc: AB033744) a closely related {Mus musculus mRNA for type II cytokeratin, complete cds homolog in species Mus musculus:: skin, muscle, bone, cartilage, Colon carcinoma, lung.

The protein similarity information, expression pattern, and map location for the Type II Cytokeratin-like protein and nucleic acid disclosed herein suggest that this Type II Cytokeratin may have important structural and/or physiological functions characteristic of the Type II Cytokeratin family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Osteoedystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

The structural similarities indicate that NOV7 may function as a member of Type II Cytokeratin family proteins. Accordingly, the NOV7 nucleic acids and proteins identified here may be useful in potential therapeutic applications implicated in (but not limited to) various pathologies and disorders as indicated herein. For example, a CDNA encoding the Type II Cytokeratin-like protein NOV7 may be useful in gene therapy, and the Type II Cytokeratin-like protein NOV7 may be useful when administered to a subject in need thereof. The NOV7 nucleic acid encoding Type II Cytokeratin-like protein, and the Type II Cytokeratin-like protein of the invention, or fragments thereof, may further be useful in diagnostic applications, wherein the presence or amount of the nucleic acid or the protein are to be assessed. Additional disease indications and tissue expression for NOV7 and NOV7 variants, if available, are presented in the Examples.

Based on the tissues in which NOV7 is most highly expressed, specific uses include developing products for the diagnosis or treatment of a variety of diseases and disorders associated therewith. Specific expression of NOV7 in normal and diseased tissues are shown in the Examples.

NOV7 nucleic acids and polypeptides are further useful in the generation of antibodies that bind immuno-specifically to the novel NOV7 substances for use in therapeutic or diagnostic methods. These antibodies may be generated according to methods known in the art, using prediction from hydrophobicity charts, as described in the "Anti-NOVX Antibodies" section below. The disclosed NOV7 protein has multiple hydrophilic regions, each of which can be used as an immunogen. In one embodiment, a contemplated NOV7 epitope is from about amino acids 1 to 25. In another embodiment, a NOV7 epitope is from about amino acids 40 to 90. In additional embodiments, NOV7 epitopes are from about amino acids 125 to 440, from about amino acids 445 to 490 and from about amino acids 495 to 536. These novel proteins can be used in assay systems for functional analysis of various human disorders, which will help in understanding of pathology of the disease and development of new drug targets for various disorders.

NOV8

NOV8 includes two novel EGF-related/CEGP1/SCUBE1-like proteins disclosed below. The disclosed proteins have been named NOV8a and NOV8b. Unless specifically addressed as NOV8a or NOV8b, any reference to NOV8 is assumed to encompass all variants.

NOV8a

A disclosed NOV8a nucleic acid (SEQ ID NO:15) of 3016 nucleotides (also referred to as 134929133_EXT) encoding a novel EGF-related/CEGP1/SCUBE1-like protein is shown in Table 8A. An open reading frame was identified beginning with an ATG initiation codon at nucleotides 101–103 and ending with a TAA codon at nucleotides 2993–2995. Putative untranslated regions are found upstream from the initiation codon and downstream from the termination codon, and are underlined. The start and stop codons are shown in bold letters in Table 8A.

TABLE 8A

NOV8a nucleotide sequence (SEQ ID NO:15).

TGGCGGAGCGGCGAGCAGCGAGCAGCGCCTGCGGGAGCGGCCGGTCGGTCGGGTCCCCGCGCCCCGCACG

CCCGCACGCCCAGCGGGGCCCGCATTGAGCATGGGCGCGGCGGCCGTGCGCTGGCACTTGTGCGTGCTGC

TGGCCCTGGGCACACGCGGGCGGCTGGCCGGGGGCAGCGGGCTCCCAGGTTCAGTCGACGTGGATGAGTG

CTCAGAGGGCACAGATGACTGCCACATCGATGCCATCTGTCAGAACACGCCCAAGTCCTACAAATGCCTC

TGCAAGCCAGGCTACAAGGGGGAAGGCAAGCAGTGTGAAGACATTGACGAGTGTGAGAATGACTACTACA

ATGGGGCTGTGTCCACGAGTGCATCAACATCCCGGGGAACTACAGGTGTACCTGCTTTGATGGCTTCAT

GCTGGCACACGATGGACACAACTGCCTGGATGTGGACGAGTGTCAGGACAATAATGGTGGCTGCCAGCAG

ATCTGCGTCAATGCCATGGGCAGCTACGAGTGTCAGTGCCACAGTGGCTTCTTCCTTAGTGACAACCAGC

ATACCTGCATCCACCGCTCCAATGAGGGTATGAACTGCATGAACAAAGACCATGGCTGTGCCCACATCTG

TABLE 8A-continued

NOV8a nucleotide sequence (SEQ ID NO:15).

```
CCGGGAGACGCCCAAAGGTGGGGTGGCCTGCGACTGCAGGCCCGGCTTTGACCTTGCCCAAAACCAGAAG
GACTGCACAGTAACCTGTAATTATGGAAACGGAGGCTGCCAGCACAGCTGTGAGGACACAGACACAGGCC
CCACGTGTGGTTGCCACCAGAAGTACGCCCTCCACTCAGACGGTCGCACGTGCATCGAGACGTGCGCAGT
CAATAACGGAGGCTGCGACCGGACATGCAAGGACACAGCCACTGGCGTGCGATGCAGCTGCCCCGTTGGA
TTCACACTGCAGCCGGACGGGAAGACATGCAAAGACATCAACGAGTGCCTGGTCAACAACGGAGGCTGCG
ACCACTTCTGCCGCAACACCGTGGGCAGCTTCGAGTGCGGCTGCCGGAAGGGCTACAAGCTGCTCACCGA
CGAGCGCACCTGCCAGGACATCGACGAGTGCTCCTTCGAGCGGACCTGTGACCACATCTGCATCAACTCC
CCGGGCAGCTTCCAGTGCCTGTGTCACCGCGGCTACATCCTCTACGGGACAACCCACTGCGGAGATGTGG
ACGAGTGCAGCATGAGCAACGGGAGCTGTGACCAGGGCTGCGTCAACACCAAGGGCAGCTACGAGTGCGT
CTGTCCCCGGGGAGGCGGCTCCACTGGAACGGGAAGGATTGCGTGGAGACAGGCAAGTGTCTTTCTCGC
GCCAAGACCTCCCCCGGGCCCAGCTGTCCTGCAGCAAGGCAGGCGGTGTGGAGAGCTGCTTCCTTTCCT
GCCCGGCTCACACACTCTTCGTGCCAGACTCGGAAAATAGCTACGTCCTGAGCTGCGGAGTTCCAGGGCC
GCAGGGCAAGGCGCTGCAGAAACGCAACGGCACCAGCTCTGGCCTCGGGCCCAGCTGCTCAGATGCCCCC
ACCACCCCATCAAACAGAAGGCCCGCTTCAAGATCCGAGATGCCAAGTGCCACCTCCGGCCCCACAGCC
AGGCACGAGCAAAGGAGACCGCCAGGCAGCCGCTGCTGGACCACTGCCATGTGACTTTCGTGACCCTCAA
GTGTGACTCCTCCAAGAAGAGGCGCCGTGGCCGCAAGTCCCCATCCAAGGAGGTGTCCCACATCACAGCA
GAGTTTGAGATCGAGACAAAGATGGAAGAGGCCTCAGGTACATGCGAAGCGGACTGCTTGCGGAAGCGAG
CAGAACAGAGCCTGCAGGCCGCCATCAAGACCCTGCGCAAGTCCATCGGCCGGCAGCAGTTCTATGTCCA
GGTCTCAGGCACTGAGTACGAGGTAGCCCAGAGGCCAGCCAAGGCGCTGGAGGGGCAGGGGGCATGTGGC
GCAGGCCAGGTGCTACAGGACAGCAAATGCGTTGCCTGTGGGCCTGGCACCCACTTCGGTGGTGAGCTCG
GCCAGTGTGTGTCATGTATGCCAGGAACATACCAGGACATGGAAGGCCAGCTCAGTTGCACACCGTGCCC
CAGCAGCGACGGGCTTGGTCTGCCTGGTGCCCGCAACGTGTCGGAATGTGGAGGCCAGTGTTCTCCAGGC
TTCTTCTCGGCCGATGGCTTCAAGCCCTGCCAGGCCTGCCCCGTGGGCACGTACCAGCCTGAGCCCGGGC
GCACCGGCTGCTTCCCCTGTGGAGGGGGTTTGCTCACCAAACACGAAGGCACCACCTCCTTCCAGGACTG
CGAGGCTAAAGTGCACTGCTCCCCCGGCCACCACTACAACACCACCACCCACCGCTGCATCCGCTGCCCC
GTCGGCACCTACCAGCCCGAGTTTGGCCAGAACCACTGCATCACCTGTCCGGGCAACACCAGCACAGACT
TCGATGGCTCCACCAACGTCACACACTGCAAAGACCAGCACTGCGGCGGCGAGCTTGGTGACTACACCGG
CTACATCGAGTCCCCCAACTACCCTGGCGACTACCCAGCCAACGCTGAATGCGTCTGGCACATCGCGCCT
CCCCCAAAGCGCAGGATCCTCATCGTGGTCCCTGAGATCTTCCTGCCCATCGAGGATGAGTGCGGCGATG
TTCTGGTCATGAGGAAGAGTGCCTCTCCCACGTCCATCACCACCTATGAGACCTGCCAGACCTACGAGAG
GCCCATCGCCTTCACCTCCCGCTCCCGCAAGCTCTGGATCCAGTTCAAATCCAATGAAGGCAACAGCGGC
AAAGGCTTCCAAGTGCCCTATGTCACCTACGATGGTAAGATCCACTGTCTTCACGGCCCACTGTGCACGG
CTCAGGCGGGGCCCTGGAGACACAGAGATGAGTCGCACGTCCCCGCCCTCAGGGAGCTGCGACCTGGCAG
GTACGGCCTCACAGAAACAGAAGGGCAAATGCAAATGCTGGGAGGAGCTGTTTAATCGTTCAGGGAGGCT
GATAGC
```

A disclosed NOV8a polypeptide (SEQ ID NO:16) encoded by SEQ ID NO:15 has 964 amino acid residues and is presented in Table 8B using the one-letter amino acid code. NOV8a has a molecular weight of 104318.38 Daltons.

TABLE 8B

Encoded NOV8a protein sequence (SEQ ID NO:16).

```
MGAAAVRWHLCVLLALGTRGRLAGGSGLPGSVDVDECSEGTDDCHIDAICQNTPKSYKCLCKPGYKGEGK
QCEDIDECENDYYNGGCVHECINIPGNYRCTCFDGFMLAHDGHNCLDVDECQDNNGGCQQICVNAMGSYE
CQCHSGFFLSDNQHTCIHRSNEGMNCMNKDHGCAHICRETPKGGVACDCRPGFDLAQNQKDCTVTCNYGN
GGCQHSCEDTDTGPTCGCHQKYALHSDGRTCIETCAVNNGGCDRTCKDTATGVRCSCPVGFTLQPDGKTC
KDINECLVNNGGCDHFCRNTVGSFECGCRKGYKLLTDERTCQDIDECSFERTCDHICINSPGSFQCLCHR
GYILYGTTHCGDVDECSMSNGSCDQGCVNTKGSYECVCPPGRRLHWNGKDCVETGKCLSRAKTSPRAQLS
CSKAGGVESCFLSCPAHTLFVPDSENSYVLSCGVPGPQGKALQKRNGTSSGLGPSCSDAPTTPIKQKARF
KIRDAKCHLRPHSQARAKETARQPLLDHCHVTFVTLKCDSSKKRRRGRKSPSKEVSHITAEFEIETKMEE
ASGTCEADCLRKRAEQSLQAAIKTLRKSIGRQQFYVQVSGTEYEVAQRPAKALEGQGACGAGQVLQDSKC
VACGPGTHFGGELGQCVSCMPGTYQDMEGQLSCTPCPSSDGLGLPGARNVSECGGQCSPGFFSADGFKPC
QACPVGTYQPEPGRTGCFPCGGGLLTKHEGTTSFQDCEAKVHCSPGHHYNTTTHRCIRCPVGTYQPEFGQ
NHCITCPGNTSTDFDGSTNVTHCKDQHCGGELGDYTGYIESPNYPGDYPANAECVWHIAPPPKRRILIVV
PEIFLPIEDECGDVLVMRKSASPTSITTYETCQTYERPIAFTSRSRKLWIQFKSNEGNSGKGFQVPYVTY
DGKIHCLHGPLCTAQAGPWRHRDESHVPALRELRPGRYGLTETEGQMQMLGGAV
```

NOV8b

A disclosed NOV8b nucleic acid (SEQ ID NO:17) of 2992 nucleotides (also referred to as CG50979-02) encoding a novel EGF-related/CEGP1/SCUBE1-like protein is shown in Table 8A. An open reading frame was identified beginning with an ATG initiation codon at nucleotides 21–23 and ending with a TAA codon at nucleotides 2985–2987. Putative untranslated regions are found upstream from the initiation codon and downstream from the termination codon, and are underlined. The start and stop codons are shown in bold letters in Table 8A.

TABLE 8C

NOV8b nucleotide sequence (SEQ ID NO:17).

```
CAGCGGGGCCCGCATTGAGCATGGGCGCGGCGGCCGTGCGCTGGCACTTGTGCGTGCTGC
TGGCCCTGGGCACACGCGGGCGGCTGGCCGGGGGCAGCGGGCTCCCAGGGTCAGTCGACG
TGGATGAGTGCTCAGAGGGCACAGATGACTGCCACATCGATGCCATCTGTCAGAACGCGC
CCAAGTCCTACAAATGCCTCTGCAAGCCAGGCTACAAGGGGGAAGGCAAGCAGTGTGGAG
ACATTGACGAGTGTGAGAATGACTACTACAATGGGGGCTGTGTCCACGAGTGCATCAACA
TCCCGGGGAACTACACGTGTACCTGCTTTGATGGCTTCATGCTGGCACACGATGGACACA
ACTGCCTGGATGTGGACGAGTGTCAGGACAATAATGGTGGCTGCCAGCAGATCTGCGTCA
ATGCCATGGGCAGCTACGAGTGTCAGTGCCACAGTGGCTTCTTCCTTAGTGACAACCAGC
ATACCTGCATCCACCGCTCCAATGAGGGTATGAACTGCATGAACAAAGACCATGGCTGTG
CCCACATCTGCCGGGAGACGCCCAAAGGTGGGGTGGCCTGCGACTGCAGGCCCGGCTTTG
ACCTTGCCCAAAACCAGAAGGACTGCACACTAACCTGTAATTATGGAAACGGAGGCTGCC
AGCACAGCTGTGAGGACACAGACACAGGCCCCACGTGTGGTTGCCACCAGAAGTACGCCC
CCCACTCAGACGGTCGCACGTGCATCGAGACGTGCGCAGTCAATAACGGAGGCTGCGACC
GGACATGCAAGGACACAGCCACTGGCGTGCGATGCAGCTGCCCCGTTGGATTCACACTGC
AGCCGGACGGGAAGACATGCAAAGACATCAACGAGTGCCTGGTCAACAACGGAGGCTGCG
ACCACTTCTGCCGCAACACCGTAGGCAGCTTCGAGTGCGGCTGCCGGAAGGGCTACAAGC
TGCTCACCGACGAGCGCACCTGCCAGGACATCGACGAGTGCTCCTTCGAGCGGACCTGTG
ACCACATCTGCATCAACTCCCCGGGCAGCTTCCAGTGCCTGTGTCACCGCGGCTACATCC
```

TABLE 8C-continued

NOV8b nucleotide sequence (SEQ ID NO:17).

```
TCTACGGGACAACCCACTGCGGAGATGTGGACGAGTGCAGCATGAGCAACGGGAGCTGTG
ACCAGGGCTGCGTCAACACCAAGGGCAGCTACGAGTGCGTCTGTCCCCGGGGAGGCGGC
TCCACTGGAACCGGAAGGATTGCGTGGAGACAGGCAAGTGTCTTTCTCGCGCCAAGACCT
CCCCCCGGGCCCAGCTGTCCTGCAGCAAGGCAGGCGGTGTGGAGAGCTGCTTCCTTTCCT
GCCCGGCTCACACACTCTTCGTGCCAGACTCGGAAAATAGCTACGTCCTGAGCTGCGGAG
TTCCAGGGCCGCAGGGCAAGGCGCTGCAGAAACGCAACGGCACCAGCTCTGGCCTCGGGC
CCAGCTGCTCAGATGCCCCCACCACCCCCATCAAACAGAAGGCCCGCTTCAAGATCCGAG
ATGCCAAGTGCCACCTCCGGCCCCACAGCCAGGCACGAGCAAAGGAGACCGCCAGGCAGC
CGCTGCTGGACCACTGCCATGTGACTTTCGTGACCCTCAAGTGTGACTCCTCCAAGAAGA
GGCGCCGTGGCCGCAAGTCCCCATCCAAGGAGGTGTCCCACATTACAGCAGAGTTTGAGA
TCGAGACAAAGATGGAAGAGGCCTCAGACACATGCGAAGCGGACTGCTTGCGGAAGCGAG
CAGAACAGAGCCTGCAGGCCGCCATCAAGACCCTGCGCAAGTCCATCGGCCGGCAGCAGT
TCTATGTCCAGGTCTCAGGCACTGAGTACGAGGTAGCCCAGAGGCCAGCCAAGGCGCTGG
AGGGGCAGGGGGCATGTGGCGCAGGCCAGGTGCTACAGGACAGCAAATGCGTTGCCTGTG
GGCCTGGCACCCACTTCGGTGGTGAGCTCGGCCAGTGTGTGCCATGTATGCCAGGAACAT
ACCAGGACATGGAAGGCCAGCTCAGTTGCACACCGTGCCCCAGCAGCGACGGGCTTGGTC
TGCCTGGTGCCCGCAACGTGTCGGAATGTGGAGGCCAGTGTTCTCCAGGCTTCTTCTCGG
CCGATGGCTTCAAGCCCTGCCAGGCCTGCCCCGTGGGCACGTACCAGCCTGAGCCCGGGC
GCACCGGCTGCTTCCCCTGTGGAGGGGGTTTGCTCACCAAACACGAAGGCACCACCTCCT
TCCAGGACTGCGAGGCTAAAGTGCACTGCTCCCCCGGCCACCACTACAACACCACCACCC
ACCGCTGCATCCGCTGCCCCGTCGGCACCTACCAGCCCGAGTTTGGCCAGAACCACTGCA
TCACCTGTCCGGGCAACACCAGCACAGACTTCGATGGCTCCACCAACGTCACACACTGCA
AAAACCAGCACTGCGGCGGCGAGCTTGGTGACTACACCGGCTACATCGAGTCCCCCAACT
ACCCTGGCGACTACCCAGCCAACGCTGAATGCGTCTGGCACATCGCACCTCCCCCAAAGC
GCAGGATCCTCATCGTGGTCCCTGAGATCTTCCTGCCCATCGAGGATGAGTGCGGCGATG
TTCTGGTCATGAGGAAGAGTGCCTCTCCCACGTCCATCACCACCTATGAGACCTGCCAGA
CCTACGAGAGGCCCATCGCCTTCACCTCCCGCTCCCGCAAGCTCTGGATCCAGTTCAAAT
CCAATGAAGGCAACAGCGGCAAAGGCTTCCAAGTGCCCTATGTCACCTACGATGAGGACT
ACCAGCAACTCATAGAGGACATCGTGCGCGATGGGCGCCTGTACGCCTCGGAGAACCACC
AGGAAATTTTGAAAGACAAGAAGCTGATCAAGGCCCTCTTCGACGTGCTGGCGCATCCCC
AGAACTACTTCAAGTACACAGCCCAGGAATCCAAGGAGATGTTCCCACGGTCCTTCATCA
AACTGCTGCGCTCCAAAGTGTCTCGGTTCCTGCGGCCCTACAAATAACCGGG
```

A disclosed NOV8b polypeptide (SEQ ID NO:18) encoded by SEQ ID NO:17 has 988 amino acid residues and is presented in Table 8B using the one-letter amino acid code. NOV8 has a molecular weight of 107896.41 Daltons.

TABLE 8D

Encoded NOV8b protein sequence (SEQ ID NO:18).

MGAAAVRWHLCVLLALGTRGRLAGGSGLPGSVDVDECSEGTDDCHIDAICQNAPKSYKCL

CKPGYKGEGKQCGDIDECENDYYNGGCVHECINIPGNYRCTCFDGFMLAHDGHNCLDVDE

TABLE 8D-continued

Encoded NOV8b protein sequence (SEQ ID NO:18).

CQDNNGGCQQICVNAMGSYECQCHSGFFLSDNQHTCIHRSNEGMNCMNKDHGCAHICRET

PKGGVACDCRPGFDLAQNQKDCTLTCNYGNGGCQHSCEDTDTGPTCGCHQKYAPHSDGRT

CIETCAVNNGGCDRTCKDTATGVRCSCPVGFTLQPDGKTCKDINECLVNNGGCDHFCRNT

VGSFECGCRKGYKLLTDERTCQDIDECSFERTCDHICINSPGSFQCLCHRGYILYGTTHC

GDVDECSMSNGSCDQGCVNTKGSYECVCPPGRRLHWNRKDCVETGKCLSRAKTSPRAQLS

CSKAGGVESCFLSCPAHTLFVPDSENSYVLSCGVPGPQGKALQKRNGTSSGLGPSCSDAP

TTPIKQKARFKIRDAKCHLRPHSQARAKETARQPLLDHCHVTFVTLKCDSSKKRRRGRKS

PSKEVSHITAEFEIETKMEEASDTCEADCLRKRAEQSLQAAIKTLRKSIGRQQFYVQVSG

TEYEVAQRPAKALEGQGACGAGQVLQDSKCVACGPGTHFGGELGQCVPCMPGTYQDMEGQ

LSCTPCPSSDGLGLPGARNVSECGGQCSPGFFSADGFKPCQACPVGTYQPEPGRTGCFPC

GGGLLTKHEGTTSFQDCEAKVHCSPGHHYNTTTHRCIRCPVGTYQPEFGQNHCITCPGNT

STDFDGSTNVTHCKNQHCGGELGDYTGYIESPNYPGDYPANAECVWHIAPPPKRRILIVV

PEIFLPIEDECGDVLVMRKSASPTSITTYETCQTYERPIAFTSRSRKLWIQFKSNEGNSG

KGFQVPYVTYDEDYQQLIEDIVRDGRLYASENHQEILKDKKLIKALFDVLAHPQNYFKYT

AQESKEMFPRSFIKLLRSKVSRFLRPYK

NOV8 Variants

SignalP, Psort and/or Hydropathy results predict that NOV8a and NOV8b have a signal peptide and is likely to be localized outside with a certainty of 0.3700. In an alternative embodiment, NOV8a and NOV8b are likely to be localized to the lysosome (lumen) with a certainty of 0.1900, or to the nucleus with a certainty of 0.1800, or to the endoplasmic reticulum (membrane) with a certainty of 0.1000. The most likely cleavage site for a NOV8a or NOV8b peptide is between amino acids 23 and 24, i.e., at the dash between amino acids RLA-GG. An alignment comparing NOV8a and NOV8b is shown in Table 8E, below. Residue differences between any NOV8 variant sequences herein are written to show the residue in the "a" variant, the residue position with respect to the "a" variant, and the residue in the "b" variant. For example, the first amino acid residue at which the NOV8 polypeptides differ, as shown in Table 8E, would be represented as T53A.

TABLE 8E

Alignment of NOV8 protein sequences

```
                             10        20        30        40        50
                     ....|....|....|....|....|....|....|....|....|....|
NOV8A 134929133_EXT  MGAAAVRWHLCVLLALGTRGRLAGGSGLPGSVDVDECSEGTDDCHIDIAG  50
NOV8B CG50979-02     MGAAAVRWHLCVLLALGTRGRLAGGSGLPGSVDVDECSEGTDDCHIDIAG  50

60        70        80        90       100
                     ....|....|....|....|....|....|....|....|....|....|
NOV8A 134929133_EXT  QNTPKSYKCLCKPGYKGEGKQCEDIDECENDYYNGGCVHECINIPGNYRC  100
NOV8B CG50979-02     QNAPKSYKCLCKPGYKGEGKQCGDIDECENDYYNGGCVHECINIPGNYRC  100

110       120       130       140       150
                     ....|....|....|....|....|....|....|....|....|....|
NOV8A 134929133_EXT  TVFDGFMLAHDGHNCLDVDECQDNNGGCQQICVNAMGSYECQCHSGFFLS  150
NOV8B CG50979-02     TVFDGFMLAHDGHNCLDVDECQDNNGGCQQICVNAMGSYECQCHSGFFLS  150

160       170       180       190       200
                     ....|....|....|....|....|....|....|....|....|....|
NOV8A 134929133_EXT  DNQHTCIHRSNEGMNCMNKDHGCAHICRETPKGGVACDCRPGFDLAQNQK  200
NOV8B CG50979-02     DNQHTCIHRSNEGMNCMNKDHGCAHICRETPKGGVACDCRPGFDLAQNQK  200

210       220       230       240       250
                     ....|....|....|....|....|....|....|....|....|....|
NOV8A 134929133_EXT  DCTVTCNYGNGGCQHSCEDTDTGPTCGCHQKYALHSDGRTCIETCAVNNG  250
NOV8B CG50979-02     DCTLTCNYGNGGCQHSCEDTDTGPTCGCHQKYAPHSDGRTCIETCAVNNG  250
```

TABLE 8E-continued

Alignment of NOV8 protein sequences

```
                     260        270        280        290        300
                  ....|....|....|....|....|....|....|....|....|....|
NOV8A 134929133_EXT  GCDRTCKDTATGVRCSCPVGFTLQPDGKTCKDINECLVNNGGCDHFCRNT  300
NOV8B CG50979-02     GCDRTCKDTATGVRCSCPVGFTLQPDGKTCKDINECLVNNGGCDHFCRNT  300

310        320        330        340        350
                  ....|....|....|....|....|....|....|....|....|....|
NOV8A 134929133_EXT  VGSFECGCRKGYKLLTDERTCQDIDECSFERTCDHICINSPGSFQCLCHR  350
NOV8B CG50979-02     VGSFECGCRKGYKLLTDERTCQDIDECSFERTCDHICINSPGSFQCLCHR  350

360        370        380        390        400
                  ....|....|....|....|....|....|....|....|....|....|
NOV8A 134929133_EXT  GYILYGITHCGDVDECSMSNGSCDQGCVNTKGSYECVCPPGRRLHWNGKD  400
NOV8B CG50979-02     GYILYGITHCGDVDECSMSNGSCDQGCVNTKGSYECVCPPGRRLHWNGKD  400

410        420        430        440        450
                  ....|....|....|....|....|....|....|....|....|....|
NOV8A 134929133_EXT  CVETGKCLSRAKTSPRAQLSCSKAGGVESCFLSCPAHTLFVPDSENSYVL  450
NOV8B CG50979-02     CVETGKCLSRAKTSPRAQLSCSKAGGVESCFLSCPAHTLFVPDSENSYVL  450

460        470        480        490        500
                  ....|....|....|....|....|....|....|....|....|....|
NOV8A 134929133_EXT  SCGVPGPQGKALQKRNGTSSGLGPSCSDAPTTPIKQKARFKIRDAKCHLR  500
NOV8B CG50979-02     SCGVPGPQGKALQKRNGTSSGLGPSCSDAPTTPIKQKARFKIRDAKCHLR  500

510        520        530        540        550
                  ....|....|....|....|....|....|....|....|....|....|
NOV8A 134929133_EXT  PHSQARAKETARQPLLDHCHVTFVTLKCDSSKKRRRGRKSPSKEVSHITA  550
NOV8B CG50979-02     PHSQARAKETARQPLLDHCHVTFVTLKCDSSKKRRRGRKSPSKEVSHITA  550

560        570        580        590        600
                  ....|....|....|....|....|....|....|....|....|....|
NOV8A 134929133_EXT  EFEIETKMEEASGTCEADCLRKRAEQSLQAAIKTLRKSIGRQQFYVQVSG  600
NOV8B CG50979-02     EFEIETKMEEASDTCEADCLRKRAEQSLQAAIKTLRKSIGRQQFYVQVSG  600

610        620        630        640        650
                  ....|....|....|....|....|....|....|....|....|....|
NOV8A 134929133_EXT  TEYEVAQRPAKALEGQGACGAGQVLQDSKCVACGPGTHFGGELGQCVSCM  650
NOV8B CG50979-02     TEYEVAQRPAKALEGQGACGAGQVLQDSKCVACGPGTHFGGELGQCVPCM  650

660        670        680        690        700
                  ....|....|....|....|....|....|....|....|....|....|
NOV8A 134929133_EXT  PGTYQDMEGQLSCTPCPSSDGLGLPGARNVSECGGQCSPGFFSADGFKPC  700
NOV8B CG50979-02     PGTYQDMEGQLSCTPCPSSDGLGLPGARNVSECGGQCSPGFFSADGFKPC  700

710        720        730        740        750
                  ....|....|....|....|....|....|....|....|....|....|
NOV8A 134929133_EXT  QACPVGTYQPEPGRTGCFPCGGGLLTKHEGTTSFQDCEAKVHCSPGHHYN  750
NOV8B CG50979-02     QACPVGTYQPEPGRTGCFPCGGGLLTKHEGTTSFQDCEAKVHCSPGHHYN  750

760        770        780        790        800
                  ....|....|....|....|....|....|....|....|....|....|
NOV8A 134929133_EXT  TTTHRCIRCPVGTYQPEFGQNHCITCPGNTSTDFDGSTNVTHCKDQHCGG  800
NOV8B CG50979-02     TTTHRCIRCPVGTYQPEFGQNHCITCPGNTSTDFDGSTNVTHCKDQHCGG  800

810        820        830        840        850
                  ....|....|....|....|....|....|....|....|....|....|
NOV8A 134929133_EXT  ELGDYTGYIESPNYPGDYPANAECVWHIAPPPKRRILIVVPEIFLPIEDE  850
NOV8B CG50979-02     ELGDYTGYIESPNYPGDYPANAECVWHIAPPPKRRILIVVPEIFLPIEDE  850

860        870        880        890        900
                  ....|....|....|....|....|....|....|....|....|....|
NOV8A 134929133_EXT  CGDVLVMRKSASPTSITTYETCQTYERPIAFTSRSRKLWIQFKSNEGNSG  900
NOV8B CG50979-02     CGDVLVMRKSASPTSITTYETCQTYERPIAFTSRSRKLWIQFKSNEGNSG  900

910        920        930        940        950
                  ....|....|....|....|....|....|....|....|....|....|
NOV8A 134929133_EXT  KGFQVPYVTYD-----------------------GKIHCLHGPLCTAQA  926
NOV8B CG50979-02     KGFQVPYVTYDEDYQQLIEDIVRDGRLYASENHQEILKDKKLIKALFDVL  950

960        970        980
                  ....|....|....|....|....|....|....
NOV8A 134929133_EXT  GPWRHRDESHVPALRELREGRYGLTETEGMQMLGGAV  964  (SEQ ID NO:16)
NOV8B CG50979-02     AHPQNYFKYTAQESKEMPERSFIKLLRSKVSRFLRPYK  988  (SEQ ID NO:18)
```

The EGF-related protein SCUBE1-like NOV8 gene disclosed in this invention maps to chromosome 22q13.31–q13.33. The EGF-related protein/CEGP1 protein genomic clones on chromosome 22 were identified by TBLASTN using proprietary sequence file for members of Ras-Related protein and/or Ras-Related protein family, run against the genomic daily files made available by GenBank or obtained from Human Genome Project Sequencing centers, and further analyzed as described for NOV1. This assignment was made using mapping information associated with genomic clones, public genes and ESTs sharing sequence identity with the disclosed sequence and CuraGen Corporation's Electronic Northern bioinformatic tool.

BLAST analysis was performed on sequences from the Patp database, which is a proprietary database that contains sequences published in patents and patent publications. Patp results include those listed in Table 8F.

TABLE 8F

Patp BLASTP Analysis for NOV8

| Sequences producing High-scoring Segment Pairs | Protein/Organism | Length (aa) | Identity (%) | Positive (%) | E Value |
|---|---|---|---|---|---|
| patp: AAY07735 | Human breast-specific BS200 protein - *Homo sapiens* | 516 | 265/438 (60%) | 329/438 (75%) | 6.8e−150 |
| patp: AAB00192 | Breast cancer protein BCO2 - *Homo sapiens* | 392 | 217/312 (69%) | 257/312 (82%) | 1.4e−128 |
| patp: AAE03843 | Human gene 3 encoded secreted protein HOGDP46, clone no: 89 - *Homo sapiens* | 934 | 144/373 (38%) | 198/373 (53%) | 8.5e−75 |
| patp: AAE03877 | Human gene 3 encoded secreted protein fragment, clone no: 127 - *Homo sapiens* | 983 | 144/373 (38%) | 198/373 (53%) | 8.5e−75 |
| patp: AAE03820 | Human gene 3 encoded secreted protein HOGDP46, clone no: 66 - *Homo sapiens* | 794 | 144/373 (38%) | 198/373 (53%) | 1.1e−74 |

In a search of sequence databases, it was found, for example, that the NOV8a nucleic acid sequence has 194 of 272 bases (71%) identical to a gb:GenBank-ID:HSA400877|acc:AJ400877.1 mRNA from *Homo sapiens* (*Homo sapiens* ASCL3 gene, CEGP1 gene, C11orf14 gene, C11orf15 gene, C11orf16 gene and C11orf17 gene). The full amino acid sequence of the NOV8a protein was found to have 848 of 960 amino acid residues (88%) identical to, and 891 of 960 amino acid residues (92%) similar to, the 961 amino acid residue ptnr:TREmblNew-ACC:AAG25939 protein from *Mus musculus* (Mouse) (EGF-related protein SCUBE1). In addition, it was found, for example, that the NOV8b nucleic acid sequence of this invention has 2431 of 2801 bases (86%) identical to a gb:GenBank-ID:AF276425|acc:AF276425.1 mRNA from *Mus musculus* (*Mus musculus* EGF-related protein SCUBE1 (Scube1) mRNA, complete cds) (FIG. 3A). The full amino acid sequence of the NOV8b protein of the invention was found to have 827 of 911 amino acid residues (90%) identical to, and 864 of 911 amino acid residues (94%) similar to, the 961 amino acid residue ptnr:SptrEmbl-ACC:Q9EQC6 protein from *Mus musculus* (Mouse) (EGF-related protein SCUBE1).

In a further search of public sequence databases, NOV8a was found to have homology to the amino acid sequences shown in the BLASTP data listed in Table 8G.

TABLE 8G

BLASTP results for NOV8

| Gene Index/Identifier | Protein/Organism | Length (aa) | Identity (%) | Positives (%) | Expect |
|---|---|---|---|---|---|
| gi|12738840|ref|NP_073560.1|NM_022723 | signal peptide, CUB domain, EGF-like 1 [*Mus musculus*] | 961 | 841/940 (89%) | 882/940 (93%) | 0.0 |
| gi|10190748|ref|NP_066025.1|NM_020974 | CEGP1 protein [*Homo sapiens*] | 999 | 569/935 (60%) | 678/935 (71%) | 0.0 |
| gi|9910154|ref|NP_064436.1|NM_020052 | Cegp1 protein; ICRFP703B1614Q5.1; ICRFP703N2430Q5.1 [*Mus musculus*] | 997 | 548/923 (59%) | 671/923 (72%) | 0.0 |
| gi|5050926|emb|CAB44772.1|Z99756 | dJ100N22.1 (novel EGF-like domain containing protein) [*Homo sapiens*] | 161 | 161/161 (100%) | 161/161 (100%) | 6e−81 |
| gi|13518037|ref|NP_002371.2|NM_002380 | matrilin 2 precursor [*Homo sapiens*] | 956 | 140/369 (37%) | 193/369 (51%) | 4e−62 |

The homology of these and other sequences is shown graphically in the ClustalW analysis shown in Table 8H. The NOV8a polypeptide is provided in lane 1. Residues that differ between NOV8a and NOV8b are marked with a ("o").

TABLE 8H

ClustalW Analysis of NOV8

1) Novel NOV8A (SEQ ID NO:16)
2) gi|12738840 (SEQ ID NO:88)
3) gi|10190748 (SEQ ID NO:89)
4) gi|9910154 (SEQ ID NO:90)
5) gi|5050926 (SEQ ID NO:91)
6) gi|13518037 (SEQ ID NO:92)

```
                                  10        20        30        40        50
                         ....|....|....|....|....|....|....|....|....|....|
NOV8 134929133_EXT       MGAAAVR-----WHLCVLIALGTRGRLAGCSGLPG-------SVDVDECS
gi|12738840|             MGAAAVR-----WHLSLLIALGARGQLVGCSGLPG-------AVDVDECS
gi|10190748|             MGVAGRNRPGAAWAVLLLLLLLPPLLLACAVPPGRGRAAGPQEDVDECA
gi|9910154|              MGVAGCGRPREARALLLILLLPP--LLAAAVPPDRGLTNGPSEDVDECA
gi|5050926|              MGAAAVR----- HLCVLIALGTRGRLAGCSGLPG-------SVDVDECS
gi|13518037|             MEKMLAG--------CFLLILGQIVLLPAEARERSRGRS---ISRGRHAR 60        70        80        90       100
                         ....|....|....|....|....|....|....|....|....|....|
                                       o                   o
NOV8 134929133_EXT       EGTDDCHIDAICQNTPKSYKCLCKPGYKGEGKQCEDIDECENDYYNGGCV
gi|12738840|             EGTDDCHIDAICQNTPKSYKCLCKPGYKGEGKQCEDIDECENDYYNGGCV
gi|10190748|             QGLDDCHADAICQNTPTSYKCSCKPGYQGEGRQCEDIDECGN-ELNGGCV
gi|9910154|              QGLDDCHADAICQNTPTSYKCSCKPGYQGEGRQCEDMDECDN-TLNGGCV
gi|5050926|              EGTDDCHIDAICQNTPKSYKCLCKPGYKGEGKQCEDIDECENDYYNGGCV
gi|13518037|             THPQTALLESSCENKRADLVFIIDSSRSVNTHDYAKVKEFIVDILQFLDI 110       120       130       140       150
                         ....|....|....|....|....|....|....|....|....|....|
NOV8 134929133_EXT       HECRNIPC--NYRCTCFDGFMLAHDGHNCLDVDECQDNNGGCQQICVNAM
gi|12738840|             HDCRNIPC--NYRCTCFDGFMLAHDGHNCLDVDECQDNNGGCQQICVNAM
gi|10190748|             HDCRNIPC--NYRCTCFDGFMLAHDGHNCLDVDECLENNGGCQHTCVNVM
gi|9910154|              HDCRNIPC--NYRCTCFDGFMLAHDGHNCLDMDECLENNGGCQHTCTNVT
gi|5050926|              HECRNIPG--NYRCTCFDGFMLAHDGHNCLDVDECQDNNGGCQQICVNAM
gi|13518037|             GPDVTRVGLLQYGSTVKNEFSLKTFKR----KSEVERAVKRMRHLSTGTM 160       170       180       190       200
                         ....|....|....|....|....|....|....|....|....|....|
NOV8 134929133_EXT       GSYECQCHSGFFLSDNQHTCIHRSNEGMNCMNKDHGCAHICRETPKGGVA
gi|12738840|             GSYECQCHSGFFLSDNQHTCIHRSNEGMNCMNKDHGCAHICRETPKGGVA
gi|10190748|             GSYECCKEGFFLSDNQHTCIHRSEEGLSCMNKDHGCSHICKEAPRGSVA
gi|9910154|              GSYECRCKEGFFLSDNQHTCIHRSEEGLSCMNKDHGCGHICKEAPRGSVA
gi|5050926|              GSYECQCHSGFFLSDNQHTCIHRSN-------------------------
gi|13518037|             TGLAIQYALNIAFSEAEGARPLRENVPRVIMIVTDGRPQDSVAEVAAKAR 210       220       230       240       250
                         ....|....|....|....|....|....|....|....|....|....|
                                    o                              o
NOV8 134929133_EXT       CDCRPGFDLAQNQKDCTVTCNYGNGGCQHSCEDTDTGPTCGCHQKYALHS
gi|12738840|             CDCRPGFDLAQNQKDCTLTCNYGNGGCQHSCEDTDTGPMCGCHQKYALHA
gi|10190748|             CECRPGFELAKNORDCILTCNHGNGGCQHSCDDTADGPECSCHPQMKMIT
gi|9910154|              CECRPGFELAKNQKDCILTCNHGNGGCQHSCEDTAEGPECSCHPRYRLHA
gi|5050926|              --------------------------------------------------
gi|13518037|             DTGILIEAIGVGQVDFNTLKSIGSEPHKDHVFLVAN---FDQIETLTSVF 260       270       280       290       300
                         ....|....|....|....|....|....|....|....|....|....|
NOV8 134929133_EXT       DGRTCIE-------------------------TCAVNNGGCDRTC
gi|12738840|             DGRTCIE-------------------------TCAVNNGGCDRTC
gi|10190748|             DGRSCLEREDTVLEVTESNTTSVVDGKRVKRRLLMETCAVNNGGCDRTC
gi|9910154|              DGRSCLEQEGTVLEGTESNATSVADGKRVKRRLLMETCAVNNGGCDRTC
gi|5050926|              --------------------------------------------------
gi|13518037|             QKKLCTAH-------------------------MCSTLEHNCAHFC 310       320       330       340       350
                         ....|....|....|....|....|....|....|....|....|....|
NOV8 134929133_EXT       KDTATGVRCSCPVGFTLQPDGKTCKDINECLVNNGGCDHFCRNTVGSFEC
gi|12738840|             KDTATGVRCSCPVGFTLQPDGKTCKDINECLMNNGGCDHFCRNTVGSFEC
gi|10190748|             KDTSTGVHCSCPVGFTLQLDGKTCKDIEECQTRNGGCNHFCKNIVGSFEC
gi|9910154|              KDTSTGVHCSCPTGFTLQVDGKTCKDIEECQTRNGGCNHFCKNIVGSFEC
gi|5050926|              --------------------------------------------------
gi|13518037|             INIPGSYVCRCKQGYILNSDQTTCRIQDLCAMEDHNCEQLCVNVPGSEVC
```

TABLE 8H-continued

ClustalW Analysis of NOV8

```
                         360        370        380        390        400
                    ....|....|....|....|....|....|....|....|....|....|
NOV8 134929133_EXT  GCRKGYKLLTDERTCQDIDECSFERT-CDHICINSPGSFQCLCHRGYILY
gi|12738840|        GCQKGHKLLTDERTCQDIDECSFERT-CDHICINSPGSFQCLCRRGYILY
gi|10190748|        GCKKGFKLLTDEKSCQDVDECSLDRT-CDHSCINHPGSFFACACNRGYTLY
gi|9910154|         SCKKGFKLLTDEKSCQDVDECSLERT-CDHSCINHPGSFFICACNPGYTLY
gi|5050926|         --------------------------------------------------
gi|13518037|        QCYSCYALAEDGKRCVAVDYCASENHGCEHECVNADGSYLCQCHEGFALN 410        420        430        440        450
                    ....|....|....|....|....|....|....|....|....|....|
NOV8 134929133_EXT  G-TTHCGDVDECSMSNGSCDQGCVNTKGSYECVCPPGRRLHWNGKDCVET
gi|12738840|        G-TTHCGDVDECSMNNGSCEQGCVNTRGSYECVCPPGRRLHWNQKDCVEM
gi|10190748|        G-FTHCGDTNECSINNGSCQQVCVNTVGSYECQCHPGYKLHWNKKDCVEV
gi|9910154|         S-FTHCGDTNECSVNNGGCQQVCINTVGSYECQCHPGFKLHWNKKDCVEV
gi|5050926|         --------------------------------------------------
gi|13518037|        PDEKTCTKIDYCASSNHGCQHECVNTDDSYSCHCLKGFTLNPDKKTCRRI 460        470        480        490        500
                    ....|....|....|....|....|....|....|....|....|....|
NOV8 134929133_EXT  GKCLSRAKTSPRAQLSCSKAGGVESCFLSCPAHTLFVPDSENSYVLSCGV
gi|12738840|        NGCLSRSKASAQAQLSCGKVGGVENCFLSCLGHSLFMPDSESSYILSCGV
gi|10190748|        KGLLPTS-VSPRVSLHCGKSGGGLGCFLRCH--------S--GIHLSSDV
gi|9910154|         KGFPPTS-MTPRVSLHCGKSGGGDRCFLRCR--------S--GIHLSSDV
gi|5050926|         --------------------------------------------------
gi|13518037|        NYVALNK---PGCEHEQVN--MEESYYCRCHRGYTLDPNGKTCSRVDHCA 510        520        530        540        550
                    ....|....|....|....|....|....|....|....|....|....|
NOV8 134929133_EXT  PGPQGKALQKRNGTSSGLGPSCSDAPTTPIKQKARFKIRDAKCHLRPHSQ
gi|12738840|        PGLQGKTLPKRNGTSSSTGPGCSDAPTTPIRQKARFKIRDAKCHLQPRSQ
gi|10190748|        TTIRTSVTFKLNEGK------CS------LKNAELF--PEGLRPALPEKH
gi|9910154|         VTVRTSVTFKLNEGK------CS------LQKAKLS--PEGLRPALPERH
gi|5050926|         --------------------------------------------------
gi|13518037|        QQDHGCEQLCLNTEDS---FVCQCSEGFLINEDLKTCSRVDYCLLSDHGC 560        570        580        590        600
                    ....|....|....|....|....|....|....|....|....|....|
NOV8 134929133_EXT  ARAKETARQPLLDHCHVTFVTLKCDSSKKRR--RGRKSPSKEVSHITABF
gi|12738840|        ERAKDTLRHPLLDNCHVTFVTLKCDSSKKRR--RGRKSPSKEVSHITABF
gi|10190748|        SSVKESFR---------YVNLTCSSGKQVPGAPGRPSTPKEM-FITVPF
gi|9910154|         SSVKESFQ---------YANLTCSPGKQVPGALGRLNAPKEM-FITVPF
gi|5050926|         --------------------------------------------------
gi|13518037|        EYSCVNMDR---------SFACQCPEGHVLRSDGKTCAKLDSCALGDHGC 610        620        630        640        650
                    ....|....|....|....|....|....|....|....|....|....|
NOV8 134929133_EXT  EIETKMEBASGTCEADCLRKRAEGSLQAAIKTLRKSIGRQQFYVQVSGTE
gi|12738840|        EVEMKVDEASGTCEADCMRKRAEQSLQAATKILRKSTGRNQEYVQVLGTF
gi|10190748|        ELETNQKEVIASCDLSCIVKRTEKRLRKAIRTLRKAVHREQFHLQLSGMN
gi|9910154|         ERPTYEKEVIASCNLSCVVKRTEKRLRKALRTLKRAAHREQFHLQLSGMD
gi|5050926|         --------------------------------------------------
gi|13518037|        EHSCVSSEDSFVCQCFEGYILREDGKTCRRKDVCQAIDHGCEHICVNSDD 660        670        680        690        700
                    ....|....|....|....|....|....|....|....|....|....|
NOV8 134929133_EXT  YEVAQRPAKALEG-QGACGAGCVLQDSKCVACGPGTHEGGELGQCVSCMP
gi|12738840|        YEVAQRPAKALEG-TGTCGIGCILQDSKCVCPAPGTYESGDPGCCMPCVS
gi|10190748|        LDVAKKPPRTSERQAESCCVGCGHAENQCVSCRAGTYDCARERCILCPN
gi|9910154|         LDMAKTPSRVSGQHEETCVGCGHEESQCVSCRAGTYDGSQERCILCPN
gi|5050926|         --------------------------------------------------
gi|13518037|        SYTCECLEGFRLAEDGKRCRRKDVCKSTHHGCEHICVNNGNSYICK-CSE 710        720        730        740        750
                    ....|....|....|....|....|....|....|....|....|....|
NOV8 134929133_EXT  GTYCDMEGCLSCTPCPSSDGLC---LPGARNCSECGGQCSPGFFSADGEK
gi|12738840|        GTYCDMEGCLSCTPCPSSEGLG---LAGARNCSCGGQCSPGYFSADGEK
gi|10190748|        GTFCNEEGCMTCEPCPRPGNSCALKTPBAWNMSECGGLCQPGEYSADGFA
gi|9910154|         GTFCNEEGCVTCEPCPRPENLGSLKISEAWNVSDCGGLCQPGEYSANGFA
gi|5050926|         --------------------------------------------------
gi|13518037|        GFVLAEDCRR-CKKCTEGP------IDLVFVIDGSKSLGEENFEVVKQFV
```

TABLE 8H-continued

ClustalW Analysis of NOV8

```
                          760        770        780        790        800
                     ....|....|....|....|....|....|....|....|....|....|
NOV8 134929133_EXT   PCQACPVGTYQPEPGRTGCFPCGGGILTKHEG---TTSFQDCEAKVHCSPG
gi|12738840|         PCQACPVGTYQPEPGRTGCFPCGGGLLTKHTG---TASFQDCEAKVHCSPG
gi|10190748|         PCQLCALGTFQPEAGRTSCFPCGGGLATKHQG---ATSFQDCETRVQCSPG
gi|9910154|          PCQLCALGTFQPDVGRTSCLSCGGGLPTKHLG---ATSFQDCETRVQCSPG
gi|5050926|          --------------------------------------------------
gi|13518037|         TGIIDSL-TISEKAARVGLLQYSTQVHTEFTLRNFNSAKDMKKAVAHMKY 810        820        830        840        850
                     ....|....|....|....|....|....|....|....|....|....|
                                                                        o
NOV8 134929133_EXT   HHYNTTTHRCIRCPVG-TYQPEFGQNHCITCPGNTSTDFDGSTNVTHCKL
gi|12738840|         HHYNTTTHRCIRCPVG-TYQPEFGQNHCISCPGNTSTDFDGSTNVTHCKN
gi|10190748|         HFYNTTTHRCIRCPVG-TYQPEFGKNNCVSCPGNTTTDFDGSTNITQCKN
gi|9910154|          HFYNTTTHRCIRCPLG-TYQPEFGKNNCVSCPGNTTTDFDGSTNITQCKN
gi|5050926|          --------------------------------------------------
gi|13518037|         MGKGSMTGLALKHMFERSFTQGECARPFSTRVPRAAIVFTDGRAQDDVSE 860        870        880        890        900
                     ....|....|....|....|....|....|....|....|....|....|
NOV8 134929133_EXT   QHCGGELGDYTGYIESPNYPGDYPANAECVWHIAPPPKRRILIVVPEIFL
gi|12738840|         QHCGGELGDYTGYIESPNYPGDYPANAECVWHIAPPPKRRILIVVPEIFL
gi|10190748|         RRCGGELGDFTGYIESPNYPGNYPANTECTWTINPPPKRRILIVVPEIFL
gi|9910154|          RKCGGELGDFTGYIESPNYPGNYPANSECTWTINPPPKRRILIVVPEIFL
gi|5050926|          --------------------------------------------------
gi|13518037|         WASKAKANGITMYAVGVG-----KAIEDELQETASEPTNKHLFYAEDFST 910        920        930        940        950
                     ....|....|....|....|....|....|....|....|....|....|
NOV8 134929133_EXT   PIEDECGDVLVMRKSASPTSITTYETCQTYERPIAFTSRSRKLWIQFKSN
gi|12738840|         PIEDECGDVLVMRKSASPTSVTTYETCQTYERPIAFTSRSRKLWIQFKSN
gi|10190748|         PIEDDCGDYLVMRKTSSNSVTTYETCQTYERPIAFTSRSKKLWIQFKSN
gi|9910154|          PIEDDCGDYLVMRKTSSNSVTTYETCQTYERPIAFTSRSKKLWIQFKSN
gi|5050926|          --------------------------------------------------
gi|13518037|         MDEISEKLKKGICEALEDSDGRQDSPAGELPKTVQQPIESEPVTINIQDL 960        970        980        990       1000
                     ....|....|....|....|....|....|....|....|....|....|
                                    ooooooooooooooooooooooooooooooooooooo
NOV8 134929133_EXT   EGNSGKGFQVPYVTYDGKIH------CLHGPLCTAQAGPWRHRDESHVPA
gi|12738840|         EANSGKGFQVPYVTYDGKSPP-----SCHSPLCASQGLAWGLRNELHIPA
gi|10190748|         EGNSARGFQVPYVTYDEDYQELIEDIVRDGRLYASENHQEILKDKKLIKA
gi|9910154|          EGNSARGFQVPYVTYDEDYQELIEDIVRDGRLYASENHQEILKDKKLIKA
gi|5050926|          --------------------------------------------------
gi|13518037|         LSCSNFAVQHRYLFEEDNLLR------STQKLSHSTKPSGSPLEEKHDQC 1010       1020       1030       1040
                     ....|....|....|....|....|....|....|....|...
                     ooooooooooooooooooooooooooooooooooooooooooo
NOV8 134929133_EXT   LRELRPGRYGLYEYEGQ----------MQMLGGAV--------
gi|12738840|         SDRAQTQRQKLGLGNAK----------TQGV------------
gi|10190748|         LFDVLAHPQNYFKYTAQESREMFPRSFIRLLRSKVSRFLRPYK
gi|9910154|          LFDVLAHPQNYFKYTAQESREMFPRSFIRLLRSKVSRFLRPYK
gi|5050926|          -------------------------------------------
gi|13518037|         KCENLIMFQNLANEEVRKLTQRLEEMTQRMEALENRLRYR---
```

The presence of identifiable domains in NOV8 was determined as described in NOV1. The presence of identifiable domains in the protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). The results indicate that this protein contains the following protein domains (as defined by Interpro) at the indicated positions: ten EGF-like domains (IPR000561) at amino acid positions 37 to 72, 78 to 115, 121 to 156, 166 to 202, 206 to 241, 245 to 280, 286 to 321, 327 to 360, 366 to 401, 737 to 773; one CUB domain IPR000859 at amino acid positions 798 to 907; and one TNFR/NGFR domain (IPR001368) at amino acid positions 649 to 687. Table 8I lists the domain description from DOMAIN analysis results against NOV8. This indicates that the NOV8 sequence has properties similar to those of other proteins known to contain these domains and similar to the properties of these domains.

TABLE 8I

Domain Analysis of NOV8 hmmpfam - search a single seq against HMM database
HMMER 2.1.1 (Dec 1998)
Copyright (C) 1992–1998 Washington University School of Medicine
HMMER is freely distributed under the GNU General Public License (GPL).
HMM file: pfamHMMs
Sequence file: /data4/genetools/kspytek48833Cg50979_02ProteinFasta.txt Query: CG50979_02
Scores for sequence family classification (score includes all domains):

| Model | Description | Score | E-value | N |
|---|---|---|---|---|
| EGF | EGF-like domain | 160.6 | 2.6e−44 | 10 |
| CUB | CUB domain | 68.4 | 1.5e−16 | 1 |

TABLE 8I-continued

Domain Analysis of NOV8

| | | | | |
|---|---|---|---|---|
| TNFR_c6 | TNFR/NGFR cysteine-rich region | 8.7 | 0.92 | 1 |
| laminin_EGF | Laminin EGF-like (Domains III and V) | −11.9 | 5.2 | 1 |
| toxin_3 | long chain scorpion toxin | −18.8 | 4.9 | 1 |

Parsed for domains:

| Model | Domain | seq-f | seq-t | hmm-f | hmm-t | score | E-value |
|---|---|---|---|---|---|---|---|
| EGF | 1/10 | 37 | 72 . . . | 1 | 45 [] | 34.4 | 2.7e−06 |
| laminin_EGF | 1/1 | 36 | 91 . . . | 1 | 59 [] | −11.9 | 5.2 |
| EGF | 2/10 | 78 | 115 . . . | 1 | 45 [] | 20.6 | 0.036 |
| EGF | 3/10 | 121 | 156 . . . | 1 | 45 [] | 37.2 | 3.7e−07 |
| EGF | 4/10 | 166 | 202 . . . | 1 | 45 [] | 22.6 | 0.0095 |
| EGF | 5/10 | 206 | 241 . . . | 1 | 45 [] | 21.0 | 0.028 |
| toxin_3 | 1/1 | 232 | 280 . . . | 1 | 69 [] | −18.8 | 4.9 |
| EGF | 6/10 | 245 | 280 . . . | 1 | 45 [] | 30.7 | 3.3e−05 |
| EGF | 7/10 | 286 | 321 . . . | 1 | 45 [] | 27.2 | 0.00038 |
| EGF | 8/10 | 327 | 360 . . . | 1 | 45 [] | 16.0 | 0.81 |
| EGF | 9/10 | 366 | 401 . . . | 1 | 45 [] | 31.3 | 2.3e−05 |
| TNFR_c6 | 1/1 | 649 | 687 . . . | 1 | 42 [] | 8.7 | 0.92 |
| EGF | 10/10 | 737 | 773 . . . | 1 | 45 [] | −5.5 | 71 |
| CUB | 1/1 | 798 | 907 . . . | 1 | 116 [] | 68.4 | 1.5e−16 |

DOMAAIN

| PSSMs producing significant alignments: | | Score(bits) | Evalue |
|---|---|---|---|
| gnl\|Smart\|smart00042 | CUB, Domain first found in C1r, C1s, uEGF, and | 85.5 | 1e−17 |
| gnl\|Pfam\|pfam00431 | CUB, CUB domain | 82.0 | 1e−16 |
| gnl\|Smart\|smart00179 | EGF_CA, Calcium-binding EGF-like domain | 37.4 | 0.004 | gnl|Smart|smart00042, CUB, Domain first found in C1r, C1s, uEGF, and bone morphogenetic protein.; This domain is found mostly among developmentally-regulated proteins. Spermadhesins contain only this domain. CD-Length = 114 residues, 99.1% aligned
gnl|Pfam|pfam00431, CUB, CUB domain. CD-Length = 110 residues, 100.0% aligned
gnl|Smart|smart00179, EGF_CA, Calcium-binding EGF-like domain. CD-Length = 41 residues, 100.0% aligned IPR000859: The CUB domain is an extracellular domain of approximately 110 residues which is found in functionally diverse, mostly developmentally regulated proteins. Almost all CUB domains contain four conserved cysteines which probably form two disulfide bridges (C1–C2, C3–C4). The structure of the CUB domain has been predicted to be a beta-barrel similar to that of immunoglobulins. Proteins that have been found to contain the CUB domain include mammalian complement subcomponents C1s/C1r, which form the calcium-dependent complex C1, the first component of the classical pathway of the complement system; hamster serine protease Casp, which degrades type I and IV collagen and fibronectin in the presence of calcium; mammalian complement-activating component of Ra-reactive factor (RARF), a protease that cleaves the C4 component of complement; vertebrate enteropeptidase, a type II membrane protein of the intestinal brush border, which activates trypsinogen; vertebrate bone morphogenic protein 1 (BMP-1), a protein which induces cartilage and bone formation and expresses metalloendopeptidase activity; sea urchins blastula proteins BP10 and SpAN; Caenorhabditis elegans hypothetical proteins F42A10.8 and R151.5; neuropilin (A5 antigen), a calcium-independent cell adhesion molecule that functions during the formation of certain neuronal circuits; fibropellins I and III from sea urchin; mammalian hyaluronate-binding protein TSG-6 (or PS4), a serum and growth factor induced protein; mammalian spermadhesins; and Xenopus embryonic protein UVS.2, which is expressed during dorsoanterior development.

IPR000561: A sequence of about thirty to forty amino-acid residues long found in the sequence of epidermal growth factor (EGF) has been shown to be present, in a more or less conserved form, in a large number of other, mostly animal proteins. The list of proteins currently known to contain one or more copies of an EGF-like pattern is large and varied. The functional significance of EGF domains in what appear to be unrelated proteins is not yet clear. However, a common feature is that these repeats are found in the extracellular domain of membrane-bound proteins or in proteins known to be secreted (exception: prostaglandin G/H synthase). The EGF domain includes six cysteine residues which have been shown (in EGF) to be involved in disulfide bonds. The main structure is a two-stranded beta-sheet followed by a loop to a C-terminal short two-stranded sheet. Subdomains between the conserved cysteines vary in length.

This indicates that the sequence of the invention has properties similar to those of other proteins known to contain this/these domain(s) and similar to the properties of these domains.

The disclosed NOV8 nucleic acid encoding a EGF-related/CEGP1/SCUBE1-like protein includes the nucleic acid whose sequence is provided in Table 8A or 8C, or variant thereof, including a SNP, fragment, homology, analog of the sequence is provided in Table 8A or 8C. The invention also includes a mutant or variant nucleic acid any of whose bases may be changed from the corresponding base shown in Table 8A OR 8C while still encoding a protein that maintains its EGF-related/CEGP1/SCUBE1-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 29% percent of the bases may be so changed of NOV8a and up to about 14% of the bases may be so changed of NOV8b.

The disclosed NOV8 protein of the invention includes the EGF-related/CEGP1/SCUBE1-like protein whose sequence is provided in Table 8B or 8D. The invention also includes a mutant or variant protein any of whose residues may be changed from the corresponding residue shown in Table 8B or 8D while still encoding a protein that maintains its EGF-related/CEGP1/SCUBE1-like activities and physiological functions, or a functional fragment thereof. In the mutant or variant protein, up to about 12% percent of the residues may be so changed of NOV8a and up to about 10% of the residues may be so changed of NOV8b.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier partcle (or biologically expressed on the surface of a carrier) such as a bacteriophage particle.

The EGF-related protein/CEGP1 protein disclosed in this invention is expressed in at least the following tissues: cervix, prostate, epithelium, liver, spleen, brain, breast, placenta, and Microdissected intraepithelial neoplasia 2 (PIN2) cells. This information was derived by determining the tissue sources of the sequences that were included in the invention including but not limited to SeqCalling sources, Public EST sources, Literature sources, and/or RACE sources.

Several polypeptide growth factors related to epidermal growth factor (EGF) have been identified recently, including transforming growth factor-alpha (TGF-alpha), amphiregulin (AR), heparin-binding EGF-like growth factor (HB-EGF), and betacellulin (BTC). These peptides all bind to the EGF receptor (EGFr). The EGF repeat motif defines a superfamily of diverse proteins. This motif features a series of conserved cysteines and glycines positioned in a domain of 30 to 40 residues. Proteins with EGF-like domains often consist of more than 1,000 amino acids, have multiple copies of the EGF-like domain, and contain additional domains known to be involved in specific protein-protein interactions. EGF-like repeat family members are predominantly secreted or cell surface molecules, often involved in the regulation of cell cycle, proliferation, developmental processes, and play a critical role in a number of extracellular events, including cell adhesion and receptor-ligand interactions. The novel human EGF-related NOV8 protein of the invention contains EGF domain and is predicted to be secreted. Therefore it is anticipated that this novel human EGF-related protein/CEGP1 protein-like Protein will have similar properties as other EGF-like proteins and may be involved in the regulation of cell cycle, proliferation, and developmental processes.

The NOV8 nucleic acids and proteins identified here may be useful in potential therapeutic applications implicated in (but not limited to) various pathologies and disorders as indicated herein. For example, a cDNA encoding the EGF-related/CEGP1/SCUBE1-like protein NOV8 may be useful in gene therapy, and the EGF-related/CEGP1/SCUBE1-like protein NOV8 may be useful when administered to a subject in need thereof. The NOV8 nucleic acid encoding EGF-related/CEGP1/SCUBE1-like protein, and the EGF-related/CEGP1/SCUBE1-like protein of the invention, or fragments thereof, may further be useful in diagnostic applications, wherein the presence or amount of the nucleic acid or the protein are to be assessed. Additional disease indications and tissue expression for NOV8 and NOV8 variants, if available, are presented in the Examples.

The protein similarity information, expression pattern, and map location for the EGF-related protein/CEGP1 protein-like protein and nucleic acid disclosed herein suggest that this EGF-related protein/CEGP1 protein may have important structural and/or physiological functions characteristic of the EGF family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from: Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, hemophilia, hypercoagulation, idiopathic thrombocytopenic purpura, immunodeficiencies, graft versus host disease, endometriosis, fertility, cirrhosis, transplantation and other diseases, disorders and conditions of the like.

The protein similarity information, expression pattern, cellular localization, and map location for the protein and nucleic acid disclosed herein suggest that this EGF-related protein SCUBE1-like protein may have important structural and/or physiological functions characteristic of the EGF-related protein SCUBE1 family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed. These also include potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), (v) an agent promoting tissue regeneration in vitro and in vivo, and (vi) a biological defense weapon.

The nucleic acids and proteins of the invention have applications in the diagnosis and/or treatment of various diseases and disorders. For example, the compositions of the present invention will have efficacy for the treatment of patients suffering from: Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, hemophilia, hypercoagulation, idiopathic thrombocytopenic purpura, immunodeficiencies, graft versus host disease, endometriosis, fertility, cirrhosis, transplantation, Cardioencephalomyopathy, fatal infantile, due to cytochrome c oxidase deficiency, Colorectal cancer; Spinocerebellar ataxia-10; Waardenburg-Shah syndrome; Yemenite deaf-blind hypopigmentation syndrome as well as other diseases, disorders and conditions.

Based on the tissues in which NOV8 is most highly expressed, specific uses include developing products for the diagnosis or treatment of a variety of diseases and disorders associated therewith. Specific expression of NOV8 in normal and diseased tissues are shown in the Examples. These materials are further useful in the generation of antibodies that bind immunospecifically to the novel substances of the invention for use in therapeutic or diagnostic methods.

NOV8 nucleic acids and polypeptides are further useful in the generation of antibodies that bind immuno-specifically to the novel NOV8 substances for use in therapeutic or diagnostic methods. These antibodies may be generated according to methods known in the art, using prediction from hydrophobicity charts, as described in the "Anti-NOVX Antibodies" section below. The disclosed NOV8 protein has multiple hydrophilic regions, each of which can be used as an immunogen. In one embodiment, a contemplated NOV8a epitope is from about amino acids 1 to 10. In another embodiment, a NOV8a epitope is from about amino acids 25 to 270. In additional embodiments, NOV8a epitopes are from about amino acids 275 to 360, from about amino acids 365 to 430, from about amino acids 450 to 520, from about amino acids 525 to 625, from about amino acids 630 to 835, and from about amino acids 850 to 964. In one embodiment, a contemplated NOV8b epitope is from about amino acids 1 to 10. In another embodiment, a NOV8b epitope is from about amino acids 25 to 270. In additional embodiments, NOV8b epitopes are from about amino acids 275 to 360, from about amino acids 365 to 430, from about amino acids 450 to 520, from about amino acids 525 to 625, from about amino acids 630 to 835, and from about amino acids 850 to 988. These novel proteins can be used in assay systems for functional analysis of various human disorders, which will help in understanding of pathology of the disease and development of new drug targets for various disorders.

NOV9

NOV9 includes two novel Potassium Channel Regulatory Subunit-like proteins disclosed below. The disclosed proteins have been named NOV9a and NOV9b. Unless specifically addressed as NOV9a or NOV9b, any reference to NOV9 is assumed to encompass all variants.

NOV9a

A disclosed NOV9a nucleic acid (SEQ ID NO:19) of 1489 nucleotides (also referred to as GSAC046130_A) encoding a novel Potassium Channel Regulatory Subunit-like protein is shown in Table 9A. An open reading frame was identified beginning with an ATG initiation codon at nucleotides 49–51 and ending with a TAA codon at nucleotides 1427–1429. Putative untranslated regions are found upstream from the initiation codon and downstream from the termination codon, and are underlined. The start and stop codons are shown in bold letters in Table 9A.

TABLE 9A

NOV9a nucleotide sequence (SEQ ID NO:19).

CAGAATTTTCCAGGAGTAGGTTCTTGGGCAGTGGCTGTGGGAGCTGGAATGGCGCAGCTGGAAGGTTACT

ATTTCTCGGCCGCCTTGAGCTGTACCTTTTTAGTATCCTGCCTCCTCTTCTCCGCCTTCAGCCGGGCGTT

GCGAGAGCCCTACATGGACGAGATCTTCCACCTGCCTCAGGCGCAGCGCTACTGTGAGGGCCATTTCTCC

CTTTCCCAGTGGGATCCCATGATTACTACATTACCTGGCTTGTACCTGGTGTCAATTGGAGTGATCAAAC

CTGCCATTTGGATCTTTGGATGGTCTGAACATGTTGTCTGCTCCATTGGGATGCTCAGATTTGTTAATCT

TCTCTTCAGTGTTGGCAACTTCTATTTACTATATTTGCTTTTCTGCAAGGTACAACCCAGAAACAAGGTA

TGTTTCAAAATACTTAATTACAAGTTTGCTGCCTCAAGTATCCAGAGAGTCTTGTCAACATTAACACTAG

CAGTATTTCCAACACTTTATTTTTTTAACTTCCTTTATTATACAGAAGCAGGATCTATGTTTTTTACTCT

TTTTGCGCATCCGATGCGCCTTTATGGAAATCATAAAACTTCAGCCTTCCTTGGATTTTGTGGCTTCATG

TTTCGGCAAACAAATATCATCTGGGCTGTCTTCTGTGCAGGAAATGTCATTGCACAAAAGTTAACGGAGG

CTTGGAAAACTGAGCTACAAAAGAAGGAAGACAGACTTCCACCTATTAAAGGACCATTTGCAGAATTCAG

AAAAATTCTTCAGTTTCTTTTGGCTTATTCCATGTCCTTTAAAAACTTGAGTATGCTTTTGCTTCTGACT

TGGCCCTACATCCTTCTGGGATTTCTGTTTTGTGCTTTTGTAGTAGTTAATGGTGGAATTGTTATTGGCG

ATCGGAGTAGTCATGAAGCCTGTCTTCATTTTCCTCAACTATTCTACTTTTTTTCATTTACTCTCTTTTT

TTCCTTTCCTCATCTCCTGTCTCCTAGCAAAATTAAGACTTTTCTTTCCTTAGTTTGGAAACGTAGAATT

CTGTTTTTTGTGGTTACCTTAGTCTCTGTGTTTTTAGTTTGGAAATTCACTTATGCTCATAAATACTTGC

TAGCAGACAATAGACATTATACTTTCTATGTGTGGAAAAGAGTTTTTCAAAGATATGAAACTGTAAAATA

TTTGTTAGTTCCAGCCTATATATTTGCTGGTTGGAGTATAGCTGACTCATTGAAATCAAAGTCAATTTTT

TGGAATTTAATGTTTTTCATATGCTTGTTCACTGTTATAGTTCCTCAGAAACTGCTGGAATTTCGTTACT

TCATTTTACCTTATGTCATTTATAGGCTTAACATACCTCTGCCTCCCACATCCAGACTCATTTGTGAACT

GAGCTGCTATGCAGTTGTTAATTTCATAACTTTTTTCATCTTTCTGAACAAGACTTTTCAGTGGCCAAAT

AGTCAGGACATTCAAAGGT

A disclosed NOV9a polypeptide (SEQ ID NO:20) encoded by SEQ ID NO:20 has 483 amino acid residues and is presented in Table 9B using the one-letter amino acid code. NOV9a has a molecular weight of 56870.61 Daltons.

TABLE 9B

Encoded NOV9a protein sequence (SEQ ID NO:20).

MAQLEGYYFSAALSCTFLVSCLLFSAFSRALREPYMDEIFHLPQAQRYCEGHFSLSQWDPMITTLPGLYL

VSIGVIKPAIWIFGWSEHVVCSIGMLRFVNLLFSVGNFYLLYLLFCKVQPRNKVCFKILNYKFAASSIQR

VLSTLTLAVFPTLYFFNFLYYTEAGSMFFTLFAHPMRLYGNHKTSAFLGFCGFMFRQTNIIWAVFCAGNV

IAQKLTEAWKTELQKKEDRLPPIKGPFAEFRKILQFLLAYSMSFKNLSMLLLLTWPYILLGFLFCAFVVV

NGGIVIGDRSSHEACLHFPQLFYFFSFTLFFSFPHLLSPSKIKTFLSLVWKRRILFFVVTLVSVFLVWKF

TYAHKYLLADNRHYTFYVWKRVFQRYETVKYLLVPAYIFAGWSIADSLKSKSIFWNLMFFICLFTVIVPQ

KLLEFRYFILPYVIYRLNIPLPPTSRLICELSCYAVVNFITFFIFLNKTFQWPNSQDIQRFMW

NOV9b

In the present invention, the target sequence identified previously, Accession Number GSAC046130_A, was subjected to the exon linking process to confirm the sequence. PCR primers were designed by starting at the most upstream sequence available, for the forward primer, and at the most downstream sequence available for the reverse primer. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences sequences from other species. These procedures provide the NOV9b sequence reported in Table 9C, which is designated Accession Number CG56017-01. This differs from the previously identified NOV9a sequence (Accession Number GSAC046130_A) in missing aminoacids 123–132 and different 133, 163, 164 and 166.

A disclosed NOV9b nucleic acid (SEQ ID NO:21) of 1461 nucleotides (also referred to as CG56017-01) encoding a novel Potassium Channel Regulatory Subunit-like protein is shown in Table 9A. An open reading frame was identified beginning with an ATG initiation codon at nucleotides 49–51 and ending with a TGA codon at nucleotides 1459–1461. Putative untranslated regions are found upstream from the initiation codon and downstream from the termination codon, and are underlined. The start and stop codons are shown in bold letters in Table 9A.

TABLE 9C

NOV9b nucleotide sequence (SEQ ID NO:21).

CAGAATTTTCCAGGAGTAGGTTCTTGGGCAGTGGCTGTGGGAGCTGGAATGGCGCAGCTG

GAAGGTTACTATTTCTCGGCCGCCTTGAGCTGTACCTTTTTAGTATCCTGCCTCCTCTTC

TCCGCCTTCAGCCGGGCGTTGCGAGAGCCCTACATGGACGAGATCTTCCACCTGCCTCAG

GCGCAGCGCTACTGTGAGGGCCATTTCTCCCTTTCCCAGTGGGATCCCATGATTACTACA

TTACCTGGCTTGTACCTGGTGTCAATTGGAGTGATCAAACCTGCCATTTGGATCTTTGGA

TGGTCTGAACATGTTGTCTGCTCCATTGGGATGCTCAGATTTGTTAATCTTCTCTTCAGT

GTTGGCAACTTCTATTTACTATATTTGCTTTTCTGCAAGGTACAACCCAGAAACAAGGCT

GCCTCAAGTATCCAGAGAGTCTTGTCAACATTAACACTAGCAGTATTTCCAACACTTTAT

TTTTTTAACTTCCTTTATTATACAGAAGCAGGATCTATGTTTTTTACTCTTTTTGCGTAT

TTGATGTGTCTTTATGGAAATCATAAAACTTCAGCCTTCCTTGGATTTTGTGGCTTCATG

TTTCGGCAAACAAATATCATCTGGGCTGTCTTCTGTGCAGGAAATGTCATTGCACAAAAG

TTAACGGAGCCTTGGAAAACTGAGCTACAAAAGAAGGAAGACAGACTTCCACCTATTAAA

GGACCATTTGCAGAATTCAGAAAAATTCTTCAGTTTCTTTTGGCTTATTCCATGTCCTTT

AAAAACTTGAGTATGCTTTTGCTTCTGACTTGGCCCTACATCCTTCTGGGATTTCTGTTT

TGTGCTTTTGTAGTAGTTAATGGTGGAATTGTTATTGGCGATCGGAGTAGTCATGAAGCC

TABLE 9C-continued

NOV9b nucleotide sequence (SEQ ID NO:21).

TGTCTTCATTTTCCTCAACTATTCTACTTTTTTTCATTTACTCTCTTTTTTTCCTTTCCT

CATCTCCTGTCTCCTAGCAAAATTAAGACTTTTCTTTCCTTAGTTTGGAAACGTAGAATT

CTGTTTTTTGTGGTTACCTTAGTCTCTGTGTTTTTAGTTTGGAAATTCACTTATGCTCAT

AAATACTTGCTAGCAGACAATAGACATTATACTTTCTATGTGTGGAAAAGAGTTTTTCAA

AGATATGAAACTGTAAAATATTTGTTAGTTCCAGCCTATATATTTGCTGGTTGGAGTATA

GCTGACTCATTGAAATCAAAGTCAATTTTTTGGAATTTAATGTTTTTCATATGCTTGTTC

ACTGTTATAGTTCCTCAGAAACTGCTGGAATTTCGTTACTTCATTTTACCTTATGTCATT

TATAGGCTTAACATACCTCTGCCTCCCACATCCAGACTCATTTGTGAACTGAGCTGCTAT

GCAGTTGTTAATTTCATAACTTTTTTCATCTTTCTGAACAAGACTTTTCAGTGGCCAAAT

AGTCAGGACATTCAAAGGTGA

A disclosed NOV9b polypeptide (SEQ ID NO:22) encoded by SEQ ID NO:21 has 470 amino acid residues and is presented in Table 9D using the one-letter amino acid code. NOV9b has a molecular weight of 55138.56 Daltons.

TABLE 9D

Encoded NOV9b protein sequence (SEQ ID NO:22).

MAQLEGYYFSAALSCTFLVSCLLFSAFSRALREPYMDEIFHLPQAQRYCEGHFSLSQWDP

MITTLPGLYLVSIGVIKPAIWIFGWSEHVVCSIGMLRFVNLLFSVGNFYLLYLLFCKVQP

RNKAASSIQRVLSTLTLAVFPTLYFFNPLYYTEAGSMFFTLFAYLMCLYGNHKTSAFLGF

CGFMFRQTNIIWAVFCAGNVIAQKLTEAWKTELQKKEDRLPPIKGPFAEFRKILQFLLAY

SMSFKNLSMLLLLTWPYILLGFLFCAFVVVNGGIVIGDRSSHEACLHFPQLFYFFSFTLF

FSFPHLLSPSKIKTFLSLVWKRRILFFVVTLVSVFLVWKFTYAHKYLLADNRHYTFYVWK

RVFQRYETVKYLLVPAYIFAGWSIADSLKSKSIFWNLMFFICLFTVIVPQKLLEFRYFIL

PYVIYRLNIPLPPTSRLICELSCYAVVFITFFIFLNKTFQWPNSQDIQR

NOV9 Variants

NOV9a and NOV9b polypeptides are likely Type IIIa membrane proteins (clv). Analysis of NOV9b with INTEGRAL software predicts a likelihood of −7.91 of having a transmembrane domain at residues 324–340 (321–343), a likelihood of −7.70 of having a transmembrane domain at residues 260–276 (247–278), a likelihood of −6.53 of having a transmembrane domain at residues 392–408 (391–410), a likelihood of −3.08 of having a transmembrane domain at residues 89–105 (89–106), a likelihood of −2.23 of having a transmembrane domain at residues 438–454 (437–457), a likelihood of −1.28 of having a transmembrane domain at residues 68–84 (67–84), and a likelihood of 0.26 of having a transmembrane domain at residues 291–307 (291–307). SignalP, Psort and/or Hydropathy results predict that either NOV9 protein has a signal peptide and is likely to be localized plasma membrane with a certainty of 0.6400. In an alternative embodiment, the NOV9 proteins are likely to be localized to the Golgi body with a certainty of 0.4600, or to the endoplasmic reticulum (membrane) with a certainty of 0.3700, or to the endoplasmic reticulum (lumen) with a certainty of 0.1000. The most likely cleavage site for a NOV9 peptide is between amino acids 30 and 31, i.e., at the dash between amino acids SRA-LR. An alignment comparing NOV9a and NOV9b is shown in Table 9E, below.

TABLE 9E

ClustalW Analysis of NOV9

```
                          10        20        30        40        50
                 ....|....|....|....|....|....|....|....|....|....|
NOV8A GSAC046130_A  MAQLEGYYFSAALSCTFLVSCLLFSAFSRALREPYMDEIFHLPQAQRYCE
NOV8B CG56017-01    MAQLEGYYFSAALSCTFLVSCLLFSAFSRALREPYMDEIFHLPQAQRYCE 60        70        80        90       100
                 ....|....|....|....|....|....|....|....|....|....|
NOV8A GSAC046130_A  GHFSLSQWDPMITTLPGLYLVSIGVIKPAIWIFGWSEHVVCSIGMLRFVN
NOV8B CG56017-01    GHFSLSQWDPMITTLPGLYLVSIGVIKPAIWIFGWSEHVVCSIGMLRFVN 110       120       130       140       150
                 ....|....|....|....|....|....|....|....|....|....|
NOV8A GSAC046130_A  LLFSVGNFYLLYLLFCKVQPRNKVCFKILNYKFAASSIQRVLSTLTLAVF
NOV8B CG56017-01    LLFSVGNFYLLYLLFCKVQPRNK----------AASSIQRVLSTLTLAVF 160       170       180       190       200
                 ....|....|....|....|....|....|....|....|....|....|
NOV8A GSAC046130_A  PTLYFFNFLYYTEAGSMFFTLFAHPMRLYGNHKTSAFLGFCGFMFRQTNI
NOV8B CG56017-01    PTLYFFNFLYYTEAGSMFFTLFAVLMCLYGNHKTSAFLGFCGFMFRQTNI 210       220       230       240       250
                 ....|....|....|....|....|....|....|....|....|....|
NOV8A GSAC046130_A  IWAVFCAGNVIAQKLTEAWKTELQKKEDRLPPIKGPFAEFRKILQFLLAY
NOV8B CG56017-01    IWAVFCAGNVIAQKLTEAWKTELQKKEDRLPPIKGPFAEFRKILQFLLAY 260       270       280       290       300
                 ....|....|....|....|....|....|....|....|....|....|
NOV8A GSAC046130_A  SMSFKNLSMLLLLTWPYILLGFLFCAFVVVNGGIVIGDRSSHEACLHFPQ
NOV8B CG56017-01    SMSFKNLSMLLLLTWPYILLGFLFCAFVVVNGGIVIGDRSSHEACLHFPQ 310       320       330       340       350
                 ....|....|....|....|....|....|....|....|....|....|
NOV8A GSAC046130_A  LFYFFSFTLFFSFPHLLSPSKIKTFLSLVWKRRILFFCCTLVSVFLVWKF
NOV8B CG56017-01    LFYFFSFTLFFSFPHLLSPSKIKTFLSLVWKRRILFFCCTLVSVFLVWKF 360       370       380       390       400
                 ....|....|....|....|....|....|....|....|....|....|
NOV8A GSAC046130_A  TYAHKYLLADNRHYTFYVWKRVFQRYETVKYLLVPAYIFAGWSIADSLKS
NOV8B CG56017-01    TYAHKYLLADNRHYTFYVWKRVFQRYETVKYLLVPAYIFAGWSIADSLKS 410       420       430       440       450
                 ....|....|....|....|....|....|....|....|....|....|
NOV8A GSAC046130_A  KSIFWNLMFFICLFTVIVPQKLLEFRYFILPYVIYRLNIPLPPTSRLICF
NOV8B CG56017-01    KSIFWNLMFFICLFTVIVPQKLLEFRYFILPYVIYRLNIPLPPTSRLICF 460       470       480
                 ....|....|....|....|....|...
NOV8A GSAC046130_A  LSCYAVVNFITFFIFLNKTFQWPNSQDIQRFMW  (SEQ ID NO:20)
NOV8B CG56017-01    LSCYAVVNFITFFIFLNKTFQWPNSQDIQR---  (SEQ ID NO:22)
```

Genomic clones of AC046130 on chromosome 12 were identified by TBLASTN using proprietary sequence file for members of Ras-Related protein and/or Ras-Related protein family, run against the genomic daily files made available by GenBank or obtained from Human Genome Project Sequencing centers, and further analyzed as described for NOV1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database that contains sequences published in patents and patent publications. Patp results include those listed in Table 9F.

TABLE 9F

Patp BLASTP Analysis for NOV9

| Sequences producing High-scoring Segment Pairs | Protein/Organism | Length (aa) | Identity (%) | Positive (%) | E Value |
|---|---|---|---|---|---|
| patp: AAB95764 | Human protein sequence clone no: 18693 - *Homo sapiens* | 317 | 313/317 (98%) | 314/317 (99%) | 4.8e-172 |

TABLE 9F-continued

Patp BLASTP Analysis for NOV9

| Sequences producing High-scoring Segment Pairs | Protein/Organism | Length (aa) | Identity (%) | Positive (%) | E Value |
|---|---|---|---|---|---|
| patp: AAB25667 | Human secreted protein sequence encoded by gene 3 clone no: 56 - Homo sapiens | 253 | 245/258 (94%) | 246/258 (95%) | 2.2e-128 |
| patp: AAB25709 | Human secreted protein sequence encoded by gene 3 clone no: 98 - Homo sapiens | 213 | 190/209 (90%) | 194/209 (92%) | 2.2e-96 |
| patp: AAB25698 | Human secreted protein sequence encoded by gene 3 clone no: 87 - Homo sapiens | 135 | 115/124 (92%) | 117/124 (94%) | 3.0e-60 |
| patp: AAB25715 | Human secreted protein sequence encoded by gene 3 clone no: 104 - Homo sapiens | 134 | 115/124 (92%) | 117/124 (94%) | 3.0e-60 |

In a search of sequence databases, it was found, for example, that the NOV9a nucleic acid sequence has 866 of 1045 bases (82%) identical to a gb:GenBank-ID:RNU78090|acc:U78090 mRNA from Rattus norvegicus (Rattus norvegicus potassium channel regulator 1 mRNA, complete cds). The full amino acid sequence of the NOV9a protein was found to have 408 of 483 amino acid residues (84%) identical to, and 440 of 483 amino acid residues (91%) similar to, the 474 amino acid residue ptnr:SptrEmbl-ACC:O88788 protein from Rattus norvegicus (Rat) (Potassium Channel Regulator 1). It was further found, for example, that the NOV9b nucleic acid sequence has 1209 of 1439 bases (84%) identical to a gb:GenBank-ID:RNU78090|acc:U78090.1 mRNA from Rattus norvegicus (Rattus norvegicus potassium channel regulator 1 mRNA, complete cds). The full amino acid sequence of the NOV9b protein was found to have 408 of 471 amino acid residues (86%) identical to, and 439 of 471 amino acid residues (93%) similar to, the 474 amino acid residue ptnr:SptrEmbl-ACC:O88788 protein from Rattus norvegicus (Rat) (Potassium Channel Regulator 1).

In a further search of public sequence databases, NOV9a was found to have homology to the amino acid sequences shown in the BLASTP data listed in Table 9G.

TABLE 9G

BLASTP results for NOV9a

| Gene Index/Identifier | Protein/Organism | Length (aa) | Identity (%) | Positives (%) | Expect |
|---|---|---|---|---|---|
| gi|14783973|ref|XP_050190.1|XM_050190 | hypothetical protein XP_050190 [Homo sapiens] | 473 | 470/483 (97%) | 471/483 (97%) | 0.0 |
| gi|14349125|emb|CAC41349.1|AJ312278 | alpha2-glucosyltransferase [Homo sapiens] | 473 | 469/483 (97%) | 470/483 (97%) | 0.0 |
| gi|3513451|gb|AAC34249.1|U78090 | potassium channel regulator 1 [Rattus norvegicus] | 474 | 408/484 (84%) | 440/484 (90%) | 0.0 |
| gi|14758202|ref|XP_047770.1|XM_047770 | hypothetical protein XP_047770 [Homo sapiens] | 413 | 392/423 (92%) | 399/423 (93%) | e-180 |
| gi|14783976|ref|XP_050195.1|XM_050195 | hypothetical protein FLJ14751 [Homo sapiens] | 317 | 314/317 (99%) | 315/317 (99%) | e-143 |

The homology of these and other sequences is shown graphically in the ClustalW analysis shown in Table 9H. The NOV9a polypeptide is provided in lane 1, and NOV9b is provided in lane 2.

TABLE 9H

ClustalW Analysis of NOV9

1) Novel NOV9a (SEQ ID NO:19)
2) Novel NOV9b (SEQ ID NO:21)
3) gi|14783973 (SEQ ID NO:93)
4) gi|14349125 (SEQ ID NO:94)
5) gi|3513451 (SEQ ID NO:95)
6) gi|14758202 (SEQ ID NO:96)
7) gi|14783976 (SEQ ID NO:97)

```
                                  10        20        30        40        50
                         ....|....|....|....|....|....|....|....|....|....|
NOV9A GSAC046130_A       MAQLEGYYFSAALSCTFLVSCLLFSAFSRALREPYMDEIFHLPQAQRYCE
NOV9B CG56017-01         MAQLEGYYFSAALSCTFLVSCLLFSAFSRALREPYMDEIFHLPQAQRYCE
gi|14783973|             MAQLEGYYFSAALSCTFLVSCLLFSAFSRALREPYMDEIFHLPQAQRYCE
gi|14349125|             MAQLEGYYFSAALSCTFLVSCLLFSAFSRALREPYMDEIFHLPQAQRYCE
gi|3513451|              MAQLEGYYFSAALSCTFLVSCLLFSAFSRALREPYMDEIFHLPQAQRYCE
gi|14758202|             --------------------------------------------------
gi|14783976|             --------------------------------------------------

60        70        80        90       100
                         ....|....|....|....|....|....|....|....|....|....|
NOV9A GSAC046130_A       GHFSLSQWDPMITTLPGLYLVSIGVIKPAIQIFGWSEHVVCSIGMLRFVN
NOV9B CG56017-01         GHFSLSQWDPMITTLPGLYLVSIGVIKPAIQIFGWSEHVVCSIGMLRFVN
gi|14783973|             GHFSLSQWDPMITTLPGLYLVSIGVIKPAIQIFGWSEHVVCSIGMLRFVN
gi|14349125|             GHFSLSQWDPMITTLPGLYLVSIGVIKPAIQIFGWSEHVVCSIGMLRFVN
gi|3513451|              GRFSLSQWDPMITTLPGLYLVSVGVVKPASQILGWSEHVVCSIGMLRFVN
gi|14758202|             ----------MITTLPGLYLVSVGVVKPAIQIHAWSEHVVCSIGMLRFVN
gi|14783976|             --------------------------------------------------

110       120       130       140       150
                         ....|....|....|....|....|....|....|....|....|....|
NOV9A GSAC046130_A       LLFSVGNFYLLYLLFCKVQPRNKVCFKILNYKFAASSIQRVLSTLTLAVF
NOV9B CG56017-01         LLFSVGNFYLLYLLFCKVQPRNK----------AASSIQRVLSTLTLAVF
gi|14783973|             LLFSVGNFYLLYLLFCKVQPRN-----------KAASSIQRVLSTLTLAVF
gi|14349125|             LLFSVGNFYLLYLLFCKVQPRNK----------AASSIQRVLSTLTLAVF
gi|3513451|              LLFSVGNFYLLYLLFRKIQPRNK----------ASSSIQRRLSTLTLAVF
gi|14758202|             LLFSVGNFYLLYLLFHKVQPRNK----------AASSIQRVLSTLTLAVF
gi|14783976|             --------------------------------------------------

160       170       180       190       200
                         ....|....|....|....|....|....|....|....|....|....|
NOV9A GSAC046130_A       PTLYFFNFLYYTEAGSMFFTLFAHPMRLYGNHKTSAFLGFCGFMFRQTNI
NOV9B CG56017-01         PTLYFFNFLYYTEAGSMFFTLFAYLMCLYGNHKTSAFLGFCGFMFRQTNI
gi|14783973|             PTLYFFNFLYYTEAGSMFFTLFAYLMCLYGNHKTSAFLGFCGFMFRQTNI
gi|14349125|             PTLYFFNFLYYTEAGSMFFTLFAYLMCLYGNHKTSAFLGFCGFMFRQTNI
gi|3513451|              PTLYFFNFLYYTEAGSVFFTLFAYLMCLYGNHRTSAFLGFCGFMFRQTNI
gi|14758202|             PTLYFFNFLYYTEAGSMFFTLFAYLMCLYGNHKTSAFLGFCGFMFRQTNI
gi|14783976|             ----------------MFFTLFAYLMCLYGNHKTSAFLGFCGFMFRQTNI 210       220       230       240       250
                         ....|....|....|....|....|....|....|....|....|....|
NOV9A GSAC046130_A       IWAVFCAGNVIAQKLTEAWKTELQKK-EDRLPPIKGPFAEFRKILQFLLA
NOV9B CG56017-01         IWAVFCAGNVIAQKLTEAWKTELQKK-EDRLPPIKGPFAEFRKILQFLLA
gi|14783973|             IWAVFCAGNVIAQKLTEAWKTELQKK-EDRLPPIKGPFAEFRKILQFLLA
gi|14349125|             IWAVFCAGNVIAQKLTEAWKTELQKK-EDRLPPIKGPFAEFRKILQFLLA
gi|3513451|              IWAAFCAGHIIAQKCSEAWKTELQKK-EDRLPAKGPLSELRRVLQFLLM
gi|14758202|             IWAVFCAGNVIAQKLTEAWKTELQKK-EDRLPPIKGPFAEFRKILQFLLA
gi|14783976|             IWAVFCAGNVIAQKLTEAWKTELQKK-EDRLPPIKGPFAEFRKILQFLLA 260       270       280       290       300
                         ....|....|....|....|....|....|....|....|....|....|
NOV9A GSAC046130_A       YSMSFKNLSMLLLLTWPYILLGFLFCAFVVVNGGIVIGDRSSHEACLHFP
NOV9B CG56017-01         YSMSFKNLSMLLLLTWPYILLGFLFCAFVVVNGGIVIGDRSSHEACLHFP
gi|14783973|             YSMSFKNLSMLLLLTWPYILLGFLFCAFVVVNGGIVIGDRSSHEACLHFP
gi|14349125|             YSMSFKNLSMLLLLTWPYTLLGFLFCAFVVVNGGIVIGDRSSHEACLHFP
gi|3513451|              YSMSLKNLSMLFLLTWPYMLLLAFFVVVVNGGIVGDRSSHEACLHFP
gi|14758202|             YSMSFKNLSMLFCLTWPYILLGFLFCAFVVVNGGIVIGDRSSHEACLHFP
gi|14783976|             YSMSFKNLSMLLLLTWPYILLGFLFCAFVVVNGGIVIGDRSSHEACLHFP 310       320       330       340       350
                         ....|....|....|....|....|....|....|....|....|....|
NOV9A GSAC046130_A       QLFYFFSFTLFFSFPHLLSPSKIKTFLSLVWKRRILFFVVTLVSVFLVWK
NOV9B CG56017-01         QLFYFFSFTLFFSFPHLLSPSKIKTFLSLVWKRRILFFVVTLVSVFLVWK
gi|14783973|             QLFYFFSFTLFFSFPHLLSPSKIKTFLSLVWKRRILFFVVTLVSVFLVWK
gi|14349125|             QLFYFFSFTLFFSFPHLLSPSKIKTFLSLVWKRRILFFVVTLVSVFLVWK
gi|3513451|              QLFYFFSFTAFFSFPHLLSPTKVKTFLSLVWKRRVQFSVITLVSVFLVWK
gi|14758202|             QLFYFFSFTLFFSFPHLLSPSKIKTFLSLVWKKFLVVTLVSVFLVWK
gi|14783976|             QLFYFFSFTLFFSFPHLLSPSKIKTFLSLVWKRRILFFVVTLVSVFLVWK
```

TABLE 9H-continued

ClustalW Analysis of NOV9

```
                              360        370        380        390        400
                         ....|....|....|....|....|....|....|....|....|....|
NOV9A GSAC046130_A       FTYAHKYLLADNRHYTFYVWKRVFQRYETVKYLLVPAYIFAGWSIADSLK
NOV9B CG56017-01         FTYAHKYLLADNRHYTFYVWKRVFQRYETVKYLLVPAYIFAGWSIADSLK
gi|14783973|             FTYAHKYLLADNRHYTFYVWKRVFQRYETVKYLLVPAYIFAGWSIADSLK
gi|14349125|             FTYAHKYLLADNRHYTFYVWKRVFQRYETVKYLLVPAYIFAGWSIADSLK
gi|3513451|              FTYVHKYLLADNRHYTFYVWKRVFQRHEIVKYLLVPAYMFAGWAVADSLK
gi|14758202|             FTYAHKYLLADNRHYTFYVWKRVFQRYAIEKYLLVPAYIFAGWSIADSLK
gi|14783976|             FTYAHKYLLADNRHYTFYVWKRVFQRYETVKYLLVPAYIFAGWSIADSLK 410        420        430        440        450
                         ....|....|....|....|....|....|....|....|....|....|
NOV9A GSAC046130_A       SKSIFWNLMFFICLFTVIVPQKLLEFRYFILPYVIYRLNIPLPPTSRLIC
NOV9B CG56017-01         SKSIFWNLMFFICLFTVIVPQKLLEFRYFILPYVIYRLNIPLPPTSRLIC
gi|14783973|             SKSIFWNLMFFICLFTVIVPQKLLEFRYFILPYVIYRLNIPLPPTSRLIC
gi|14349125|             SKSIFWNLMFFICLFTVIVPQKLLEFRYFILPYVIYRLNIPLPPTSRLIC
gi|3513451|              SKSIFWNLMFFVCLVASTVPQKLLEFRYFILPYIIYRLNMPLPPISRLVC
gi|14758202|             SKEIFWNLMFFICLFIVIVPQKLLEFRYFILPYVIYRLNITLPPTSRLVC
gi|14783976|             SKSIFWNLMFFICLFTVIVPQKLLEFRYFILPYVIYRLNIPLPPTSRLIC 460        470        480
                         ....|....|....|....|....|....|....|
NOV9A GSAC046130_A       ELSCYAVVNFITFFIFLNKTFQWPNSQDIQRFMW
NOV9B CG56017-01         ELSCYAVVNFITFFIFLNKTFQWPNSQDIQR---
gi|14783973|             ELSCYAVVNFITFFIFLNKTFQWPNSQDIQRFMW
gi|14349125|             ELSCYAVVNFITFFIFLNKTFQWPNSQDIQRFMW
gi|3513451|              ELGCYAVVNFLTFYIFLNKTFQWSDSHDIQRFMW
gi|14758202|             ELSCYAIVNFITFYIFLNKTFQWPNSQDIQRFMW
gi|14783976|             ELSCYAVVNFITFFIFLNKTFQWPNSQDIQRFMW
```

No known domains were identified in NOV9, using DOMAIN analysis software.

The disclosed NOV9 nucleic acid encoding a Potassium Channel Regulatory Subunit-like protein includes the nucleic acid whose sequence is provided in Table 9A or 9C, or variant thereof, including a SNP, fragment, homology, analog of the sequence is provided in Table 9A or 9C. The invention also includes a mutant or variant nucleic acid any of whose bases may be changed from the corresponding base shown in Table 9A or 9C while still encoding a protein that maintains its Potassium Channel Regulatory Subunit-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 18% percent of the bases may be so changed of NOV9a and up to about 16% of the bases mayb be so changed of NOV9b.

The disclosed NOV9 protein of the invention includes the Potassium Channel Regulatory Subunit-like protein whose sequence is provided in Table 9B or 9D. The invention also includes a mutant or variant protein any of whose residues may be changed from the corresponding residue shown in Table 9B or 9D while still encoding a protein that maintains its Potassium Channel Regulatory Subunit-like activities and physiological functions, or a functional fragment thereof. In the mutant or variant protein, up to about 16% percent of the residues may be so changed of NOV9a and up to about 14% of the residues may be so changed of NOV9b.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier partcle (or biologically expressed on the surface of a carrier) such as a bacteriophage particle.

Cerebellar granule neurons possess a non-inactivating K+ current, which controls resting membrane potentials and modulates the firing rate by means of muscarinic agonists. kcr1 was cloned from the cerebellar cDNA library by suppression cloning. KCR1 is a novel protein with 12 putative transmembrane domains and enhances the functional expression of the cerebellar non-inactivating K+ current in Xenopus oocytes. KCR1 also accelerates the activation of rat EAG K+ channels expressed in Xenopus oocytes or in COS-7 cells. Far-Western blotting revealed that KCR1 and EAG proteins interacted with each other by means of their C-terminal regions. These results suggest that KCR1 is the regulatory component of non-inactivating K+ channels. PMID: 9722534, UI: 98389735 1. Signal transduction pathways activated during growth of human breast cancer cells in tissue culture are reviewed. 2. Steroid hormones and growth factors stimulate similar mitogenic pathways and frequently modulate each other's activity. 3. A response common to estrogen, progestins and most polypeptide mitogens is induction of the nuclear transcription factors myc, fos and jun in early G1 phase of the cell cycle. 4. Some growth factors also stimulate cyclin D1, a regulatory protein responsible for the activation of cell cycle-dependent kinases in G1. 5. In addition, insulin, IGF-I and EGF activate tyrosine kinase receptors. 6. Several tyrosine phosphorylated proteins occur in human breast cancer cells, and include the EGF and estrogen receptors. 7. Cyclic AMP plays a critical role in breast cancer cell proliferation through the activation of protein kinase A, and it also modulates the activity of estrogen and progesterone receptors. 8. EGF is the only breast cell mitogen known to raise intracellular free calcium levels. 9. Calcium may play a dual role in breast cancer cell proliferation, activating both calmodulin-dependent processes and regulating cell membrane potential through the activation of potassium channels. 10. Potassium channel activity and cell proliferation are linked in breast cancer cells, the cell membrane potential shifting between a depolarized state in G1/G0 cells and a hyperpolarized state during S phase. 11. Activation of an ATP-sensitive potassium channel is required for breast cancer cells to undergo the G1/G0-S transition. PMID: 8745151, UI: 96343052

The Potassium Channel Regulatory Subunit disclosed in this invention is expressed in at least the following tissues: Whole Organism, Nervous System, brain, ovary, lung, myelogenous leukemia cell, Testis, cervix. This information was derived by determining the tissue sources of the sequences that were included in the invention. SeqCalling sources: Whole Organism, Nervous System. PublicEST sources: brain, ovary, lung, myelogenous leukemia cell, Testis, cervix, RACE sources: : Whole Organism, Nervous System, brain, ovary, lung, myelogenous leukemia cell, Testis, cervix.

The protein similarity information, expression pattern, and map location for the Potassium Channel Regulatory Subunit-like NOV9 protein and nucleic acid disclosed herein suggest that this Potassium Channel Regulatory Subunit may have important structural and/or physiological functions characteristic of the Potassium Channel Regulatory Subunit family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients such as Immuno therapy of inflammatory and infectious diseases such as AIDS, cancer therapy, treatment of Neurologic diseases, Brain and/or autoimmune disorders like encephalomyelitis, neurodegenerative disorders, Alzheimer's Disease, Parkinson's Disorder, immune disorders, and hematopoietic disorders, endocrine diseases, muscle disorders, inflammation and wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, Parkinson's disease, acute heart failure, hypotension, hypertension, urinary retention, osteoporosis, Crohn's disease; multiple sclerosis; and Treatment of Albright Hereditary Ostocodystrophy, angina pectoris, myocardial infarction, ulcers, asthma, allergies, benign prostatic hypertrophy, and psychotic and neurological disorders, including anxiety, schizophrenia, manic depression, delirium, dementia, severe mental retardation and dyskinesias, such as Huntington's disease or Gilles de la Tourette syndrome and/or other pathologies and disorders.

The NOV9 nucleic acids and proteins identified here may be useful in potential therapeutic applications implicated in (but not limited to) various pathologies and disorders as indicated herein. For example, a cDNA encoding the Potassium Channel Regulatory Subunit-like protein NOV9 may be useful in gene therapy, and the Potassium Channel Regulatory Subunit-like protein NOV9 may be useful when administered to a subject in need thereof. The NOV9 nucleic acid encoding Potassium Channel Regulatory Subunit-like protein, and the Potassium Channel Regulatory Subunit-like protein of the invention, or fragments thereof, may further be useful in diagnostic applications, wherein the presence or amount of the nucleic acid or the protein are to be assessed. Additional disease indications and tissue expression for NOV9 and NOV9 variants, if available, are presented in the Examples.

Based on the tissues in which NOV9 is most highly expressed, specific uses include developing products for the diagnosis or treatment of a variety of diseases and disorders associated therewith. Specific expression of NOV9 in normal and diseased tissues are shown in the Examples.

NOV9 nucleic acids and polypeptides are further useful in the generation of antibodies that bind immuno-specifically to the novel NOV9 substances for use in therapeutic or diagnostic methods. These antibodies may be generated according to methods known in the art, using prediction from hydrophobicity charts, as described in the "Anti-NOVX Antibodies" section below. The disclosed NOV9 protein has multiple hydrophilic regions, each of which can be used as an immunogen. In one embodiment, a contemplated NOV9a epitope is from about amino acids 1 to 10. In another embodiment, a NOV9a epitope is from about amino acids 25 to 65. In additional embodiments, NOV9a epitopes are from about amino acids 110 to 135, from about amino acids 160 to 195, from about amino acids 205 to 245, from about amino acids 280 to 305, from about amino acids 315 to 335, from about amino acids 340 to 380, and from about amino acids 455 to 483. In one embodiment, a contemplated NOV9b epitope is from about amino acids 1 to 10. In another embodiment, a NOV9b epitope is from about amino acids 25 to 65. In additional embodiments, NOV9b epitopes are from about amino acids 110 to 135, from about amino acids 170 to 185, from about amino acids 200 to 240, from about amino acids 260 to 290, from about amino acids 305 to 320, from about amino acids 330 to 375, and from about amino acids 445 to 470. These novel proteins can be used in assay systems for functional analysis of various human disorders, which will help in understanding of pathology of the disease and development of new drug targets for various disorders.

NOV10

NOV10 includes two novel Faciogenital Dysplasia Protein-like proteins disclosed below. The disclosed proteins have been named NOV10a and NOV10b. Unless specifically addressed as NOV10a or NOV10b, any reference to NOV10 is assumed to encompass all variants.

NOV10a

A disclosed NOV10a nucleic acid (SEQ ID NO:23) of 2068 nucleotides (also referred to as 28477694_A) encoding a novel Faciogenital Dysplasia Protein-like protein is shown in Table 10A. An open reading frame was identified beginning with an ATG initiation codon at nucleotides 25–27 and ending with a TGA codon at nucleotides 1990–1992. Putative untranslated regions are found upstream from the initiation codon and downstream from the termination codon, and are underlined. The start and stop codons are shown in bold letters in Table 10A.

TABLE 10A

NOV10a nucleotide sequence (SEQ ID NO:23).

GGATCCACCCCGGAAACCGGCAGGATGAAGGGGGCAAGTGAGGAGAAGCTGGCATCTGTGTCCAACCTGG
TCACTGTGTTTGAGAATAGCAGGACCCCAGAAGCAGCACCCAGAGGCCAGACGCTACAGGACGTCCATCA
CCGCCCTGAGTGCAGGCCTCCCGAGTCCCCAGGACCACGGGAGAAGACGAATGTCGGGGAGGCCGTGGGG
TCTGAGCCCAGGACAGTCAGCAGGAGGTACCTGAACTCCCTGAAGAACAAGCTGTCCAGCGAAGCCTGGA
GGAAATCTTGCCAGCCTGTGACCCTCTCAGGATCGGGACGCAGGGAGCCAGAGAAGAAGATCGTCCAGGA
GCTGCTGGAGACAGAGCAGGCCTATGTGGCGCGCCTCCACCTGCTAGACCAGGTGTTTTTCCAGGAGCTG
CTGAAGACAGCCCGCAGCAGCAAGGCCTTCCCAGAGGATGTGGTCAGGGTCATCTTCTCCAACATCTCCT
CCATCTATCAGTTCCATTCTCAGTTCTTCCTCCCAGAGCTGCAGCGGCGCCTGGACGACTGGACAGCTAA
CCCCCGCATCGGTGACGTGATCCAGAAGCTGGCCCCCTTCCTGAAGATGTACAGTGAGTATGTCAAGAAC
TTTGAGCGAGCGGCTGAGCTGCTGGCCACCTGGACCGACAAGTCTCCACTCTTCCAGGAGGTTCTCACTC
GCATCCAGAGCAGCGAGGCTTCGGGCAGCCTGACCCTGCAGCACCACATGCTGGAACCAGTGCAGAGAAT
TCCACGTTACGAGCTGCTGCTCAAGGAGTACATCCAGAAGCTGCCAGCCCAGGCCCCAGACCAGGCCGAT
GCCCAGAGAGCCCTGGACATGATCTTCTCAGCTGCCCAGCACTCCAATGCAGCCATCACTGAGATGGAGC
GGCTGCAGGACCTGTGGGAGGTGTACCAGCGCCTGGGCCTCGAGGACGACATAGTAGACCCCTCTAACAC
CCTGCTCCGTGAGGGCCCGGTCCTCAAGATCTCCTTCCGCCGCAACGACCCCATGGAGCGCTACCTTTTC
TTGTTCAACAACATGCTGCTCTACTGTGTGCCCAGGGTGATCCAGGTGGGCGCCCAGTTCCAGGTGAGGA
CCCGCATCGATGTGGCCGGGATGAAGGTAAGAGAGCTGATGGATGCTGAGTTTCCCCACTCCTTCCTGGT
GTCCGGGAAGCAGCGCACCCTGGAGCTGCAAGCCCGGTCCCAGGAGGAAATGATTTCCTGGATGCAGGCC
TTCCAAGCAGCCATTGACCAAATCGAGAAGCGGAATGAAACCTTCAAGGCTGCGGCCCAGGGGCCTGAGG
GAGACATCCAGGAGCCACAGCTGCAGTCTGAGGAGCTGGGCCTCCGGGCACCGCAGTGGGTCCGGGACAA
GATGGTGACCATGTGCATGCGCTGCCAGGAGCCCTTCAACGCTCTGACGCGCCGTCGCCACCACTGCCGG
GCCTGCGGCTATGTGGTGTGTGCCAGGTGCTCCGACTACCGGGCCGAACTGAAATACGACGACAACAGGC
CCAACCGAGTCTGCCTCCACTGCTACGCATTCCTCACTCGAAATGTGCTGCCTGAGGCCAAGGAGGACAA
GAGGCGGGGCATCCTGGAGAAAGGGTCCTCAGCCACGCCTGACCAGAGCCTGATGTGCAGCTTCCTGCAG
CTCATCGGGGACAAGTGGGGCAAGAGCGGCCCCCGGGGCTGGTGTGTGATCCCTCGGGATGACCCCCTCG
TGCTCTATGTCTATGCTGCCCCTCAGGACATGAGGGCTCACACCTCCATCCCCCTGCTGGGCTACCAGGT
GACTGTTGGGCCCCAGGGGGACCCTCGGGTCTTCCAGCTACAGCAGTCAGGCCAGCTCTACACCTTCAAG
GCCGAGACGGAGGAGCTGAAGGGCCGCTGGGTGAAGGCCATGGAGCGGGCGGCCAGTGGCTGGAGCCCCA
GCTGGCCCAACGATGGGGACCTGTCCGATTGAGCCACTGCCAGCCGCTTTCCTGCCCTCTCCCTGAAATA
AAGAACAGCTTGCCAGAAAAAAAAAAAAAAAAAAAAAAAA

A disclosed NOV10a polypeptide (SEQ ID NO:24) encoded by SEQ ID NO:23 has 655 amino acid residues and is presented in Table 10B using the one-letter amino acid code. SignalP, Psort and/or Hydropathy results predict that NOV10a has no known signal peptide and is likely to be localized microbody (peroxisome) with a certainty of 0.3000. In an alternative embodiment, NOV10a is likely to be localized to the nucleus with a certainty of 0.3000, or to the mitochondrial matrix space with a certainty of 0.1000, or to the lysosome (lumen) with a certainty of 0.1000. NOV10a has a molecular weight of 74967.55 Daltons.

TABLE 10B

Encoded NOV10a protein sequence (SEQ ID NO:24).

MKGASEEKLASVSNLVTVFENSRTPEAAPRGQRLEDVHHRPECRPPESPGPREKTNVGEAVGSEPRTVSR

RYLNSLKNKLSSEAWRKSCQPVTLSGSGRREPEKKIVQELLETEQAYVARLHLLDQVFFQELLKTARSSK

TABLE 10B-continued

Encoded NOV10a protein sequence (SEQ ID NO:24).

AFPEDVVRVIFSNISSIYQFHSQFFLPELQRRLDDWTANPRIGDVIQKLAPFLKMYSEYVKNFERAAELL

ATWTDKSPLFQEVLTRIQSSEASGSLTLQHHMLEPVQRIPRYELLLKEYIQKLPAQAPDQADAQRALDMI

FSAAQHSNAAITEMERLQDLWEVYQRLGLEDDIVDPSNTLLREGPVLKISFRRNDPMERYLELFNNMLLY

CVPRVIQVGAQFQVRTRIDVAGMKVRELMDAEFPHSFLVSGKQRTLELQARSQEEMISWMQAFQAAIDQI

EKRNETFKAAAQGPEGDIQEPQLQSEELGLRAPQWVRDKMVTMCMRCQEPFNALTRRRHHCRACGYVVCA

RCSDYRAELKYDDNRPNRVCLHCYAFLTGNVLPEAKEDKRRGILEKGSSATPDQSLMCSFLQLIGDKWGK

SGPRGWCVIPRDDPLVLYVYAAPQDMRAHTSIPLLGYQVTVGPQGDPRVFQLQQSGQLYTFKAETEELKG

RWVKANERAASGWSPSWPNDGDLSD

NOV10b

A disclosed NOV10b nucleic acid (SEQ ID NO:25) of 2135 nucleotides (also referred to as CG110519-01) encoding a novel Faciogenital Dysplasia Protein-like protein is shown in Table 10A. An open reading frame was identified beginning with an ATG initiation codon at nucleotides 34–36 and ending with a TGA codon at nucleotides 2053–2055. Putative untranslated regions are found upstream from the initiation codon and downstream from the termination codon, and are underlined. The start and stop codons are shown in bold letters in Table 10A.

TABLE 10C

NOV10b nucleotide sequence (SEQ ID NO:25).

<u>GGGTAGCTGAGATCCACCCCGGAAACCGGCAGG</u>ATGAAGGGGGCAAGTGAGGAGAAGCTG

GCATCTGTGTCCAACCTGGTCACTGTGTTTGAGAATAGCAGGACCCCAGAAGCAGCACCC

AGAGGCCAGAGGCTAGAGGACGTGCATCACCGCCCTGAGTGCAGGCCTCCCGAGTCCCCA

GGACCACGGGAGAAGACGAATGTCGGGGAGGCCGTCGGGTCTGAGCCCAGGACAGTCAGC

AGGAGGTACCTGAACTCCCTGAAGAACAAGCTGTCCAGCGAAGCCTGGAGGAAATCTTGC

CAGCCTGTGACCCTCTCAGGATCGGGGACGCAGGAGCCAGAGAAGAAGATCGTCCAGGAG

CTGCTGGAGACAGAGCAGGCCTATGTGGCGCGCCTCCACCTGCTAGACCAGGTGTTTTTC

CAGGAGCTGCTGAAGACAGCCCGCAGCAGCAAGGCCTTCCCAGAGGATGTGGTCAGGGTC

ATCTTCTCCAACATCTCCTCCATCTATCAGTTCCATTCTCAGTTCTTCCTCCCAGAGCTG

CAGCGGCGCCTGGACGACTGGGCTAACCCCCGCATCGGTCACGTGATCCAGAAGCTGGCC

CCCTTCCTGAAGATGTACAGTGAGTATGTCAAGAACTTTGAGCGAGCGGCTGAGCTGCTG

GCCACCTGGACCGACAAGTCTCCACTCTTCCAGGAGGTTCTCACTCGCATCCAGACCGAG

GCTTCGGGCAGCCTGACCCTGCAGCACCACATGCTGGAACCAGTGCAGAGAATTCCACGT

TACGAGCTGCTGCTCAAGGAGTACATCCAGAAGCTGCCAGCCCAGGCCCCAGACCAGGCC

GATGCCCAGGCCCTGGACATGATCTTCTCAGCTGCCCAGCACTCCAATGCAGCCATCACT

GAGATGGAGCGGCTGCAGGACCTGTGGGAGGTGTACCAGCGCCTGGGCCTCGAGGACGAC

ATACTAGACCCCTCTAACACCCTGCTCCGTGAGGGCCCGGTCCTCAAGATCTCCTTCCGC

CGCAACGACCCCATGGAGCGCTACCTTTTCTTGTTCAACAACATGCTGCTCTACTGTGTG

CCCAGGGTGATCCAGGTGGGCCCCCAGTTCCAGGTGAGCACCCGCATCGATGTGGCCGGG

ATGAAGGTAAGAGAGCTGATGGATGCTGAGTTTCCCCACTCCTTCCTGGTGTCCGGGAAG

CAGCGCACCCTGGAGCTGCAAGCCCGGTCCCAGGAGGAAATGATTTCCTGGATGCAGGCC

TTCCAAGCAGCCATTGACCAAATCGAGAAGCGGAATGAAACCTTCAAGGCTGCGGCCCAG

GGGCCTGAGCGAGACATCCAGGAGCCACAGCTGCAGTCTGAGGAGCTGGGCCTCCGGGCA

TABLE 10C-continued

NOV10b nucleotide sequence (SEQ ID NO:25).

CCGCAGTGGGTCCGGGACAAGATGGTGACCATGTGCATGCGCTGCCAGGAGCCCTTCAAC

GCTCTGACGCGCCGTCGCCACCACTGCCGGGCCTGCGGCTATGTGGTGTGTGCCAGGTGC

TCCGACTACCGGGCCGAACTGAAATACGACGACAACAGGCCCAACCGAGTCTGCCTCCAC

TGCTACGCATTCCTCACTGGAAATGTGCTGCCTGAGGCCAAGGAGGACAAGAGGCGGGGC

ATCCTGGACAAAGGGTCCTCAGCCACGCCTGACCAGAGCCTGATGTGCAGCTTCCTGCAG

CTCATCGGGGACAAGTGGGGCAAGAGCGGCCCCCGGGGCTGGTGTGTGATCCCTCGGGAT

GACCCCCTCGTGCTCTATGTCTATGCTGCCCCTCAGGACATGAGGGCTCACACCTCCATC

CCCCTGCTGGGCTACCAGGTGACTGTTGGGCCCCAGGGGCCCTCCGGTCTTCCAGCTACA

GCAGTCAGGCCAGCTCTACACCTTCAAGGCCGAGACGGAGGAGCTGAAGGGCCGCTGGGT

GAAGGCCATGGAGCGGGCGGCCAGTGGCTGGAGCCCAGCTGGCCCAACGATGGGGACCT

GTCCGACTGAGCCACTGCCAGCCGCTCTCCTGCCCACCTCTCCCCACCCTGAACCCAGCT

CCTGCCACAGACTGACCCTGTGGCCTCAGTGACCCACTGCCCCAAGTGGTGCTTTCAGAG

AATTGATTCAGCCATCTGCGCCCAGGCCACGTGTC

A disclosed NOV10b polypeptide (SEQ ID NO:26) encoded by SEQ ID NO:25 has 673 amino acid residues and is presented in Table 10B using the one-letter amino acid code. SignalP, Psort and/or Hydropathy results predict that NOV10b has no known signal peptide and is likely to be localized microbody (peroxisome) with a certainty of 0.3000. In an alternative embodiment, NOV10b is likely to be localized to the nucleus with a certainty of 0.3000, or to the lysosome (lumen) with a certainty of 0.1562, or to the mitochondrial matrix space with a certainty of 0.1000. NOV10 has a molecular weight of 76086.88 Daltons.

NOV10 Variants

NOV10a and NOV10b have different C-terminal ends. In addition, NOV10b is missing 3 amino acids—175T, 230S and 275R—compared to NOV10a, and has two different amino acids, namely R99T, R100Q. An alignment comparing NOV10a and NOV10b is shown in Table 10E, below.

TABLE 10D

Encoded NOV10b protein sequence (SEQ ID NO:26).

MKGASEEKLASVSNLVTVFENSRTPEAAPRGQRLEDVHHRPECRPPESPGPREKTNVGEA

VGSEPRTVSRRYLNSLKNKLSSEAWRKSCQPVTLSGSGTQEPEKKIVQELLETEQAYVAR

LHLLDQVFFQELLKTARSSKAFPEDVVRVIFSNISSIYQFHSQFFLPELQRRLDDWANPR

IGDVIQKLAPFLKMYSEYVKNFERAAELLATWTDKSPLFQEVLTRIQSEASGSLTLQHHM

LEPVQRIPRYELLLKEYIQKLPAQAPDQADAQALDMIFSAAQHSNAAITEMERLQDLWEV

YQRLGLEDDIVDPSNTLLREGPVLKISFRRNDPMERYLFLFNNMLLYCVPRVIQVGAQFQ

VRTRIDVAGMKVRELMDAEFPHSFLVSGKQRTLELQARSQEEMISWMQAFQAAIDQIEKR

NETFKAAAQGPEGDIQEPQLQSEELGLRAPQWVRDKMVTMCMRCQEPFNALTRRRHHCRA

CGYVVCARCSDYRAELKYDDNRPNRVCLHCYAFLTGNVLPEAKEDKRRGILEKGSSATPD

QSLMCSFLQLIGDKWGKSGPRGWCVIPRDDPLVLYVYAAPQDMRAHTSIPLLGYQVTVGP

QGPSGLPATAVRPALHLQGRDGGAEGPLGEGHGAGGQWLEPQLAQRWGPVRLSHCQPLSC

PPLPTLNPAPATD

TABLE 10E

Alignment of NOV10 protein sequences

```
                       10         20         30         40         50
                ....|....|....|....|....|....|....|....|....|....|
NOV10A 28477694_A  MKGASEEKLASVSNLVTVFENSRTPEAAPRGQRLEDVHHRPECRPPESPG
NOV10B G110519-01  MKGASEEKLASVSNLVTVFENSRTPEAAPRGQRLEDVHHRPECRPPESPG 60         70         80         90        100
                ....|....|....|....|....|....|....|....|....|....|
NOV10A 28477694_A  PREKTNVGEAVGSEPRTVSRRYLNSLKNKLSSEAWRKSCQPVTLSGSGRR
NOV10B G110519-01  PREKTNVGEAVGSEPRTVSRRYLNSLKNKLSSEAWRKSCQPVTLSGSGTQ 110        120        130        140        150
                ....|....|....|....|....|....|....|....|....|....|
NOV10A 28477694_A  EPEKKIVQELLETEQAYVARLHLLDQVFFQELLKTARSSKAFPEDVVRVI
NOV10B G110519-01  EPEKKIVQELLETEQAYVARLHLLDQVFFQELLKTARSSKAFPEDVVRVI 160        170        180        190        200
                ....|....|....|....|....|....|....|....|....|....|
NOV10A 28477694_A  FSNISSIYQFHSQFFLPELQRRLDDWTANPRIGDVIQKLAPFLKMYSEYV
NOV10B G110519-01  FSNISSIYQFHSQFFLPELQRRLDDW-ANPRIGDVIQKLAPFLKMYSEYV 210        220        230        240        250
                ....|....|....|....|....|....|....|....|....|....|
NOV10A 28477694_A  KNFERAAELLATWTDKSPLFQEVLTRIQSSEASGSLTLQHHMLEPVQRIP
NOV10B G110519-01  KNFERAAELLATWTDKSPLFQEVLTRIQS-EASGSLTLQHHMLEPVQRIP 260        270        280        290        300
                ....|....|....|....|....|....|....|....|....|....|
NOV10A 28477694_A  RYELLLKEYIQKLPAQAPDQADAQRALDMIFSAAQHSNAAITEMERLQDL
NOV10B G110519-01  RYELLLKEYIQKLPAQAPDQADAQ-ALDMIFSAAQHSNAAITEMERLQDL 310        320        330        340        350
                ....|....|....|....|....|....|....|....|....|....|
NOV10A 28477694_A  WEVYQRLGLEDDIVDPSNTLLREGPVLKISFRRNDPMERYLFLFNNMLLY
NOV10B G110519-01  WEVYQRLGLEDDIVDPSNTLLREGPVLKISFRRNDPMERYLFLFNNMLLY 360        370        380        390        400
                ....|....|....|....|....|....|....|....|....|....|
NOV10A 28477694_A  CVPRVIQVGAQFQVRTRIDVAGMKVRELMDAEFPHSFLVSGKQRTLELQA
NOV10B G110519-01  CVPRVIQVGAQFQVRTRIDVAGMKVRELMDAEFPHSFLVSGKQRTLELQA 410        420        430        440        450
                ....|....|....|....|....|....|....|....|....|....|
NOV10A 28477694_A  RSQEEMISWMQAFQAAIDQIEKRNETFKAAAQGPEGDIQEPQLQSEELGL
NOV10B G110519-01  RSQEEMISWMQAFQAAIDQIEKRNETFKAAAQGPEGDIQEPQLQSEELGL 460        470        480        490        500
                ....|....|....|....|....|....|....|....|....|....|
NOV10A 28477694_A  RAPQWVRDKMVTMCMRCQEPFNALTRRRHHCRACGYVVCARCSDYRAELK
NOV10B G110519-01  RAPQWVRDKMVTMCMRCQEPFNALTRRRHHCRACGYVVCARCSDYRAELK 510        520        530        540        550
                ....|....|....|....|....|....|....|....|....|....|
NOV10A 28477694_A  YDDNRPNRVCLHCYAFLTGNVLPEAKEDKRRGILEKGSSATPDQSLMCSF
NOV10B G110519-01  YDDNRPNRVCLHCYAFLTGNVLPEAKEDKRRGILEKGSSATPDQSLMCSF 560        570        580        590        600
                ....|....|....|....|....|....|....|....|....|....|
NOV10A 28477694_A  LQLIGDKWGKSGPRGWCVIPRDDPLVLYVYAAPQDMRAHTSIPLLGYQVT
NOV10B G110519-01  LQLIGDKWGKSGPRGWCVIPRDDPLVLYVYAAPQDMRAHTSIPLLGYQVT 610        620        630        640        650
                ....|....|....|....|....|....|....|....|....|....|
NOV10A 28477694_A  VGPQGDP--------RVFQLQ-QSGQLYTFKAETEELKGRWVKAMERAAS
NOV10B G110519-01  VGPQGPSGLPATAVRPALHLQGRDCGAEGPLGEGHGAGCGWEEPQLAQRW 660        670
                ....|....|....|....|.
NOV10A 28477694_A  G---------WSPSWP--NDGDLSD  (SEQ ID NO:24)
NOV10B G110519-01  GPVRLSHCQPLSCEPLPTLNPAPAID (SEQ ID NO:26)
```

The faciogenital dysplasia protein-like NOV10 protein disclosed in this invention maps to chromosome 6. Genomic clones were identified by TBLASTN using proprietary sequence file for members of Ras-Related protein and/or Ras-Related protein family, run against the genomic daily files made available by GenBank or obtained from Human Genome Project Sequencing centers, and further analyzed as described for NOV1. This information was assigned using OMIM and the electronic northern tool from Curatools to derive the the chromosomal mapping of the SeqCalling assemblies, Genomic clones, and/or EST sequences that were included in the invention.

BLAST analysis was performed on sequences from the Patp database, which is a proprietary database that contains sequences published in patents and patent publications.

Patp results include those listed in Table 10F.

ptnr:SptrEmbl-ACC:O88841 protein from *Mus musculus* (Mouse) (Faciogenital Dysplasia Protein 2). It was also found, for example, that the NOV10b nucleic acid sequence has 1385 of 1711 bases (80%) identical to a gb:GenBank-ID:AF017368|acc:AF017368.1 mRNA from *Mus musculus* (*Mus musculus* faciogenital dysplasia protein 2 (Fgd2) mRNA, complete cds). The full amino acid sequence of the NOV10b protein was found to have 516 of 632 amino acid

TABLE 10F

Patp BLASTP Analysis for NOV10

| Sequences producing High-scoring Segment Pairs | Protein/Organism | Length (aa) | Identity (%) | Positive (%) | E Value |
|---|---|---|---|---|---|
| patp: AAY51248 | Rat actin-binding protein frabin - Rattus sp | 766 | 316/646 (48%) | 435/646 (67%) | 1.1e−158 |
| patp: AAU17096 | Novel signal transduction pathway protein, clone no: 661 - Homo sapiens | 687 | 190/388 (48%) | 281/388 (72%) | 1.5e−104 |
| patp: AAU17364 | Novel signal transduction pathway protein, clone no: 929 - Homo sapiens | 363 | 145/277 (52%) | 217/277 (78%) | 5.7e−82 |
| patp: AAU17094 | Novel signal transduction pathway protein, clone no: 659 - Homo sapiens | 319 | 145/287 (50%) | 201/287 (70%) | 1.9e−74 |
| patp: AAB93568 | Human protein sequence clone no: 12972 - Homo sapiens | 432 | 105/285 (36%) | 156/285 (54%) | 5.4e−59 |

In a search of sequence databases, it was found, for example, that the NOV10a nucleic acid sequence has 1654 of 2008 bases (82%) identical to a gb:GenBank-ID:AF017368|acc:AF017368.1 mRNA from *Mus musculus* (*Mus musculus* faciogenital dysplasia protein 2 (Fgd2) mRNA, complete cds). The full amino acid sequence of the NOV10a protein was found to have 496 of 600 amino acid residues (82%) identical to, and 530 of 600 amino acid residues (88%) similar to, the 727 amino acid residue residues (81%) identical to, and 552 of 632 amino acid residues (87%) similar to, the 727 amino acid residue ptnr:SptrEmbl-ACC:O88841 protein from *Mus musculus* (Faciogenital Dysplasia Protein 2).

In a further search of public sequence databases, NOV10 was found to have homology to the amino acid sequences shown in the BLASTP data listed in Table 10G.

TABLE 10G

BLASTP results for NOV10

| Gene Index/ Identifier | Protein/Organism | Length (aa) | Identity (%) | Positives (%) | Expect |
|---|---|---|---|---|---|
| gi\|7305055\| ref\|NP_038738.1\| NM_013710 | faciogenital dysplasia homolog 2 (human) [*Mus musculus*] | 727 | 496/600 (82%) | 530/600 (87%) | 0.0 |
| gi\|15705415\| gb\|AAL05631.1\| AF402611_1 AF402611 | actin-binding protein frabin-alpha [*Mus musculus*] | 766 | 297/550 (54%) | 400/550 (72%) | e−167 |
| gi\|3342246\| gb\|AAC27698.1\| AF038388 | actin-filament binding protein Frabin [*Rattus norvegicus*] | 766 | 297/550 (54%) | 401/550 (72%) | e−167 |
| gi\|16552927\| dbj\|BAB71413.1\| AK057294 | unnamed protein product [*Homo sapiens*] | 766 | 294/548 (53%) | 399/548 (72%) | e−166 |
| gi\|4758358\| ref\|NP_004454.1\| NM_004463 | faciogenital dysplasia protein [*Homo sapiens*] | 961 | 302/612 (49%) | 415/612 (67%) | e−153 |

The homology of these and other sequences is shown graphically in the ClustalW analysis shown in Table 10H. The NOV10a polypeptide is provided in lane 1, and NOV10b is in lane 2.

TABLE 10H

ClustalW Analysis of NOV10

1) Novel NOV10a (SEQ ID NO:24)
2) Novel NOV10b (SEQ ID NO:26)
3) gi|7305055 (SEQ ID NO:98)
4) gi|15705415 (SEQ ID NO:99)
5) gi|3342246 (SEQ ID NO:100)
6) gi|16552927 (SEQ ID NO:101)
7) gi|4758358 (SEQ ID NO:102)

```
                                    10        20        30        40        50
                             ....|....|....|....|....|....|....|....|....|....|
NOV10A 28477694_A            --------------------------MKGASEEKLASVSNLVTVFEN--
NOV10B G110519-01            --------------------------MKGASEEKLASVSNLVTVFEN--
gi|7305055|                  --------------------------MERACEKQDSVCNLVAVFEN--
gi|15705415|                 -----------------MEESNPAPTSCTSKGKHSKVSDLISHFEGGS
gi|3342246|                  -----------------MEESNPAPTSCASKGKHSKVSDLISHFEGGS
gi|16552927|                 -----------------MEEIKPASASCVSKEKPSKVSDLISRFEGGS
gi|4758358|                  MHGHRAPGGRRAFGARTPGHEPAGAAPPACADSDPGASEPGLLARRGSGS 60        70        80        90       100
                             ....|....|....|....|....|....|....|....|....|....|
NOV10A 28477694_A            --------------SRTPEAAPRG-------------------------
NOV10B G110519-01            --------------SRTPEAAPRG-------------------------
gi|7305055|                  --------------NRTPGEAPGS-------------------------
gi|15705415|                 VLSSYIDLQKDSTMNLNIPQTLGQ-------------------------
gi|3342246|                  VLSSYTDVQKDSTMNLNIPQTPRQ-------------------------
gi|16552927|                 SLSNYSDLKKESAVNLNAPRTPGR-------------------------
gi|4758358|                  ALGGPLDPQFYGPSDTSLGAAPGHRVLPCGPSPQHHRALTFSYHLEGSQP 110       120       130       140       150
                             ....|....|....|....|....|....|....|....|....|....|
NOV10A 28477694_A            --------------------QRLEDVHHRPECRPPES------------
NOV10B G110519-01            --------------------QRLEDVHHRPECRPPES------------
gi|7305055|                  --------------------HSLEDQPHIPEHQLSLS------------
gi|15705415|                 ------------PGLTSSPPKKFLPQHS-PQKQENDP------------
gi|3342246|                  ------------HGLTSTTPQKLPSHKS-PQKQEKDS------------
gi|16552927|                 ------------HGLTTTPQKLLSQHL-PQRQGNDA------------
gi|4758358|                  RPGLHQGNRILVKSLSLDPGQSLEPHPEGPQRLRSDPGPPTETPSQRPSP 160       170       180       190       200
                             ....|....|....|....|....|....|....|....|....|....|
NOV10A 28477694_A            -------------------------------------------------
NOV10B G110519-01            -------------------------------------------------
gi|7305055|                  -------------------------------------------------
gi|15705415|                 ------------------------------------DQTQGQ----
gi|3342246|                  ------------------------------------DQNQGQ----
gi|16552927|                 ------------------------------------DKTQGA----
gi|4758358|                  LKRAPGPKPQVPPKPSYLQMPRMPPPLEPIPPPPSRPLPADPRVGKGLAP 210       220       230       240       250
                             ....|....|....|....|....|....|....|....|....|....|
NOV10A 28477694_A            ---P--GPREKTNVGEAVGSEPRTVS---------------RRY------
NOV10B G110519-01            ---P--GPREKTNVGEAVGSEPRTVS---------------RRY------
gi|7305055|                  ---P--EPWEAPPVKEALKSFFRPVS---------------RTY------
gi|15705415|                 HGCLANGVVAAQNQMECEDEKETTLSPEMAIQTAAASPDTHVLN------
gi|3342246|                  HGCLANGVVAAQSQMECETEKEAALSPETDTQTAAASPDAHVLN------
gi|16552927|                 QTCVANGVMAAQNQMECEEEKAATLSSDTAIQASEPLLDTHIVN------
gi|4758358|                  RAEASPSSAAVSSLIEKFEREPVIVASDRPVPGPSPGPPEPVMLPQPTSQ 260       270       280       290       300
                             ....|....|....|....|....|....|....|....|....|....|
NOV10A 28477694_A            ---------------------------------------LNSLKN------
NOV10B G110519-01            ---------------------------------------LNSLKN------
gi|7305055|                  ---------------------------------------LSSLKN------
gi|15705415|                 --------------------GERN-------ETITDSASSIAN------
gi|3342246|                  --------------------GVRN-------ETTTDSASSVTN------
gi|16552927|                 --------------------GERD-------ETATAPASPTTD------
gi|4758358|                  PPVPQLPEGEASRCLFLLAPGPRDGEKCPNRDSGIDSISSPSNSEETCFV 310       320       330       340       350
                             ....|....|....|....|....|....|....|....|....|....|
NOV10A 28477694_A            ----KLSSEAWRKS----------CQPVTLSG----SGRPDPE-------
NOV10B G110519-01            ----KLSSEAWRKS----------CQPVTLSG----SGTPDPE-------
gi|7305055|                  ----KLSSGAWRRS----------CQPGVSPG----PETQPPE-------
gi|15705415|                 SHDENASDSSCRTP------GTDLGLPSKEGEPGMDAELQPRENGVNTMG
gi|3342246|                  SHDENACDSSCRTQ------GTDLGLPSKEGEPVIEAELQPRENGLSTEG
gi|16552927|                 SCDGNASDSSYRTP------GIGPVLPLEERGAETETKVQPRENGESPLE
gi|4758358|                  SDDGPPSHSLCPGPPALASVPVALADPHRPSQEVDSDLREEDDEEEEEE
```

TABLE 10H-continued

ClustalW Analysis of NOV10

```
                         360        370        380        390        400
                    ....|....|....|....|....|....|....|....|....|....|
NOV10A 28477694_A   ------------------------KKIVQELLETEQAYVARLHLLDQVEF
NOV10B G110519-01   ------------------------KKIVQELLETEQAYVARLHLLDQVEF
gi|7305055|         ------------------------KRVVRELETEQAYVARLHLLDQVEF
gi|15705415|        LDT------LDQHHEVKETNEQKLHKIATELLLTERAYVSRLDLLDQVEY
gi|3342246|         LNP------LDQHHEVKETNEQKLHKIATELLLTERAYVSRLNLLDQVEY
gi|16552927|        LEQ------LDQHHEMKETNEQKLHKIANELLLTERAYVNRLDLLDQVEY
gi|4758358|         KDREIPVPLMERQESVELTVQQKVFHIANELLQTEKAYVSRLHLLDQVEC 410        420        430        440        450
                    ....|....|....|....|....|....|....|....|....|....|
NOV10A 28477694_A   QELLKTARSSKAFPEDVVRVIFSNISSIYQFHSQFFLPELQRRIDDWTAN
NOV10B G110519-01   QELLKTARSSKAFPEDVVRVIFSNISSIYQFHSQFFLPELQRRIDDW-AN
gi|7305055|         QKLLREAGRSKAFPEDVVKLIFSNISSIYRFHAQFFLPELQRRVDDWAAT
gi|15705415|        CKLLEEA-NRGSFPAEMVNKIFSNISSINAFHSKFLLPELEKRMQEWETT
gi|3342246|         CKLLEEA-NRGSFPAEMVNKIFSNISSINAFHSKFLLPELEKRMQEWETT
gi|16552927|        CKLLEEA-NRGSFPAEMVNKIFSNISSINAFHSKFLLPELEKRMQEWETT
gi|4758358|         ARLLEEARNRSSFPADVVHGIFSNICSIYCFHQQFLLPELEKRMEEWDRY 460        470        480        490        500
                    ....|....|....|....|....|....|....|....|....|....|
NOV10A 28477694_A   PRIGDVIQKLAPFLKMYSEYVKNFERAAELLAIWTDKSPLFQEVLTRIQS
NOV10B G110519-01   PRIGDVIQKLAPFLKMYSEYVKNFERAAELLAIWTDKSPLFQEVLTRIQS
gi|7305055|         PRIGDVIQKLAPFLKMYSEYVKNFERAAELLAIWMDKSQPFQEVLTRIQC
gi|15705415|        PRIGDILQKLAPFLKMYGEYVKGFDNAVELVKTMTERVPQFKSVTEEIQK
gi|3342246|         PRIGDILQKLAPFLKMYGEYVKGFDNAVELVKNMTERVPQFKSVTEEIQK
gi|16552927|        PRIGDILQKLAPFLKMYGEYVKGFDNAMELVKNMTERIPQFKSVKEEIQK
gi|4758358|         PRIGDILQKLAPFLKMYGEYVKNFDRAVELVNIWTERSTQFKVIIHEVQK 510        520        530        540        550
                    ....|....|....|....|....|....|....|....|....|....|
NOV10A 28477694_A   SEASGSLTLQHHMLEPVQRIPRYELLLKEYIQKLPAQAPDQADAQRALDM
NOV10B G110519-01   -EASGSLTLQHHMLEPVQRIPRYELLLKEYIQKLPAQAPDQADAQ-ALDM
gi|7305055|         SEASSSLTLQHHMLEPVQRIPRYELLLKEYVQKLPAQAPDLEDAQRALDM
gi|15705415|        QRICGSLTLQHHMLEPIQRIPRYEMLLKDYLKKISPDSPDWNDAKKSLEI
gi|3342246|         QRICGSLTLQHHMLEPIQRIPRYEMLLKDYLKKISPDAPDWNDAKKSLEI
gi|16552927|        QRICGSLTLQHHMLEPVQRIPRYELLLKDYLRKLPDSLDWNDAKKSLEI
gi|4758358|         EKACGNLTLQHHMLEPVQRIPRYELLLKDYLLKLPHGSPDSKDAQKSLRL 560        570        580        590        600
                    ....|....|....|....|....|....|....|....|....|....|
NOV10A 28477694_A   IFSAAQHSNAAITEMERLQDIWEVYQRLGLEDDIVDPSNTLLREGPVLKI
NOV10B G110519-01   IFSAAQHSNAAITEMERLQDIWEVYQRLGLEDDIVDPSNTLLREGPVLKI
gi|7305055|         IFSAAQHSNAAIAEMERLQGLWEVYQRLGLEEDIVDPSNTLLREGPVLKL
gi|15705415|        ISTAASHSNSAIRKMENLKKLLEIYEMLGEEEDIVNPSNELIKEGQILKL
gi|3342246|         ISTAASHSNSAIRKMENLKKLLEIYEMLGEEEDIVNPSNELIKEGQILKL
gi|16552927|        ISTAASHSNSAIRKMENLKKLLEIYKMLGEEEDIVNPSNELIKEGQILKL
gi|4758358|         IATAAEHSNAAIRKMERMHKLLKVYELLCGEEDIVSPTKELIKEGHILKL 610        620        630        640        650
                    ....|....|....|....|....|....|....|....|....|....|
NOV10A 28477694_A   SFRRNDPMERYLFLFNNMLLYCVPRVIQVGAQFQVRTRIDVAGMKVRELM
NOV10B G110519-01   SFRRNDPMERYLFLFNNMLLYCVPRVIQVGAQFQVRTRIDVAGMKVRELM
gi|7305055|         SFRRSDPMERYLVLFNNMLLYCVPRVLQVGAQFQVRTRIDVAGMKVRELT
gi|15705415|        AARNTSAQERYLFLFNNMLLYCVPRFSLVGSKFIVRTRVGIDGMKIVETH
gi|3342246|         AARNTSAQERYLFLFNNMLLYCVPRFSLVGSKFIVRTRVGIDGMKIVETH
gi|16552927|        AARNTSAQERYLFLFNNMLLYCVPKFSLVGSKFIVRTRVGIDGMKIVETQ
gi|4758358|         SAKNGTTQDRYLILFNDRLLYCVPRLRLLGQKFSVRARIDVDGMEIKESS 660        670        680        690        700
                    ....|....|....|....|....|....|....|....|....|....|
NOV10A 28477694_A   DAEEPHSFLVSGKQRTLELQARSQEEMISWMQAFQAAILQIEKRNETFK-
NOV10B G110519-01   DAEEPHSFLVSGKQRTLELQARSQEEMISWMQACQAAILQIEKRNETFK-
gi|7305055|         DAEEPHSFLVSGKQRTLELQARSRDEMVSWMQACQAAILQVEKRSETFK-
gi|15705415|        NEEYPHTFQISGKERTLELQASSEQDKEEWIKALQESIDAFHQRHETFR-
gi|3342246|         NEEYPHTFQVSGKERTLELQASSEQDKEEWIKALQESIDAFHQRHETFR-
gi|16552927|        NEEYPHTFQVSGKERTLELQASSAQDKEEWIKALQETIDAFHQRHETFR-
gi|4758358|         NLNLPRTFLVSGKQRSLELQARTEEEKKDWVQAINSTLKHEQTLETFKL 710        720        730        740        750
                    ....|....|....|....|....|....|....|....|....|....|
NOV10A 28477694_A   -AAAQGPEGDIQEPQLQSEELGLRAPQWVRDKMVTMCMFCQEPFNALTRR
NOV10B G110519-01   -AAAQGPEGDIQEPQLQSEELGLRAPQWVRDKMVTMCMFCQEPFNALTRR
gi|7305055|         -AAVQGPQGDTQEPKPQVEELGLRAPQWVRDKMVTMCMFCQEPFNALTRR
gi|15705415|        -NAIAKEN-DIP-LEVSTAELGKRAPRWIRDNEVTMCMKCKESFNALTRR
gi|3342246|         -NAIAKEN-DIP-LEVSTAELGKRAPRWIRDNEVTMCMKCKESFNALTRR
gi|16552927|        -NAIAKDN-DIH-SEVSTAELGKRAPRWIRDNEVTMCMKCKEPFNALTRR
gi|4758358|         LNSTNREDEDTP-PNSPNVDLGKRAPTPIRKKEVTMCMFCQEPFNSITKR
```

TABLE 10H-continued

ClustalW Analysis of NOV10

```
                         760        770        780        790        800
                    ....|....|....|....|....|....|....|....|....|....|
NOV10A 28477694_A   RHHCRACGYVVCARCSDYRARLKYDDNRPNRVCLHCYAFLTGNVLPEAK-
NOV10B G110519-01   RHHCRACGYVVCARCSDYRARLKYDDNRPNRVCLHCYAFLTGNVLPEAK-
gi|7305055|         RHHCRACGYVVCWKCSDYKARLKYDSNRPNRVCLTCYTFLTGNVLPQGK-
gi|15705415|        RHHCRACGYVVCWKCSDYKAQLEYDGGRLNKVCKDCYQIISG--FTDSE-
gi|3342246|         RHHCRACGHVVCWKCSDYKAQLEYDGGRLNKVCKDCYQIMSG--GAKSE-
gi|16552927|        RHHCRACGYVVCQKCSDYKAQLEYDGGKLSKVCKDCYQIISG--FTDSE-
gi|4758358|         RHHCKACGYVVCGKCSEFRARLVYDNNRSNRVTDCYVALHG--VPGSSP 810        820        830        840        850
                    ....|....|....|....|....|....|....|....|....|....|
NOV10A 28477694_A   ------EDKRRGILEKGSSATPDQSLMCSFLQLTGDKWGKSGPRGWCVIP
NOV10B G110519-01   ------EDKRRGILEKGSSATPDQSLMCSFLQLTGDKWGKSGPRGWCVIP
gi|7305055|         ------EDKRRGILEKEASAAPEQSLVCSFLQLIGDKCSRSLPRSWCVIP
gi|15705415|        ------EKKRRGILEIESAEVSGNSEVCSFLQYMEKS--KPWQKIWCVIP
gi|3342246|         ------EKKRRGILEIESAEVSGNSEVCSFLQYMEKS--KPWQKIWCVIP
gi|16552927|        ------EKKRKGILEIESAEVSGNSVVCSFLQYMEKS--KPWQKAWCVIP
gi|4758358|         ACSQHTPQRRSILEKQASVAAENSVICSFLHYMEKGG-KGWHKAWFVVP 860        870        880        890        900
                    ....|....|....|....|....|....|....|....|....|....|
NOV10A 28477694_A   RDDPLVLYVYAAPQDMRAHTSIPLLGYQVTVGPQGDP---------RVFQL
NOV10B G110519-01   RDDPLVLYVYAAPQDMRAHTSIPLLGYQVTVGPQGPSGLPATAVRPALHL
gi|7305055|         RDDPLVLYVYAAPQDTKAHTSIPLLGYQVISGPQGTSGFPAATVTTAVHL
gi|15705415|        KQDPLVLYNYGAPQDVRAQATIPLLGYVVD--DMPKS----ADLPHSEKL
gi|3342246|         KQDPLVLYMYGAPQDVRAQATIPLLGYIVD--DMPKS----ADLPHSEKL
gi|16552927|        KQDPLVLYMYGAPQDVRAQATIPLLGYVVD--EMPRS----ADLPHSEKL
gi|4758358|         ENEPLVLYTYGAPQDVKAQRSLPLTGFEVGPPEAGER----PDRRHVEKI 910        920        930        940        950
                    ....|....|....|....|....|....|....|....|....|....|
NOV10A 28477694_A   Q-QSGQLYTEKAETPELKG----------RWVKAMERAASG---------
NOV10B G110519-01   QGRDGGAEGPLGEGHGAGG----------QWLEPQLAQRWGPVRLSHCQP
gi|7305055|         QGRVCGAAGPLGDSYQACASGTPEDLTKKMCLTEPAASCSSRVHDSLPRP
gi|15705415|        T-QSKSVHSFAADNEELKQ----------KWLKIILLAVTG---------
gi|3342246|         T-QSKSVHSFAADSEELKQ----------KWLKIILLAVTG---------
gi|16552927|        T-QSKSVHSFAADSEELKQ----------KWLKVILLAVTG---------
gi|4758358|         T-QSHLSWYFSPETPELQR----------RWMAVLGRAGRGDTFCPGPTL 960        970        980        990        1000
                    ....|....|....|....|....|....|....|....|....|....|
NOV10A 28477694_A   ------WSESWP--NDGDLSD-----------------------------
NOV10B G110519-01   L---SCPPLPTLNPAPATD-------------------------------
gi|7305055|         TPWFYHFTESWATPDPPDVYTETIHPDSVSSRHRPFPSGRYHQVSQLAGE
gi|15705415|        ------ETPDGPSEHLATLNNLPG-PKKKSEC------------------
gi|3342246|         ------ETPDGPSEHLDTLDNLPG-PKEKSEC------------------
gi|16552927|        ------ETEGGPNEHPATLDDHPE-PKKKSEC------------------
gi|4758358|         SE--DREMEEAPVAALGATAEPPESPQTRDKT------------------

....|..
NOV10A 28477694_A   -------
NOV10B G110519-01   -------
gi|7305055|         GADIPGS
gi|15705415|        -------
gi|3342246|         -------
gi|16552927|        -------
gi|4758358|         -------
```

The presence of identifiable domains in NOV10 was determined as described in NOV1. The presence of identifiable domains in the NOV10a protein disclosed herein was determined by searches using algorithms such as PROSITE, Blocks, Pfam, ProDomain, Prints and then determining the Interpro number by crossing the domain match (or numbers) using the Interpro website (http:www.ebi.ac.uk/interpro/). The results indicate that this protein contains the following protein domains (as defined by Interpro) at the indicated positions: GEF domain IPR000219 at amino acid positions 106 to 289, pleckstrin homology domain IPR001605 at amino acid positions 320 to 418, FYVE domain IPR000306 at amino acid positions 453 to 519. Table 10I lists domain descriptions from pfam analysis for NOV10b and from DOMAIN analysis results against NOV10a. This indicates that the NOV10 sequence has properties similar to those of other proteins known to contain these domains and similar to the properties of these domains.

TABLE 10I

Domain Analysis of NOV10

HMM file: pfamHMMs
Sequence file: /data4/genetools/mpattu15594Cg11051901ProteinFasta.txt Query: CG110519-01
Scores for sequence family classification (score includes all domains):

| Model | Description | Score | E-value | N |
|---|---|---|---|---|
| RhoGEF | RhoGEF domain | 205.3 | 9.3e−58 | 1 |
| FYVE | FYVE zinc finger | 94.4 | 3.2e−25 | 1 |
| PH | PH domain | 65.6 | 4.9e−17 | 2 |
| DAG_PE-bind | Phorbol esters/diacylglycerol binding dom | −6.5 | 0.81 | 1 |

Parsed for domains:

| Model | Domain | seq-f | seq-t | hmm-f | hmm-t | score | E-value |
|---|---|---|---|---|---|---|---|
| RhoGEF | 1/1 | 106 | 286 ... | 1 | 207 [] | 205.3 | 9.3e−58 |
| PH | 1/2 | 317 | 415 ... | 1 | 85 [] | 61.5 | 6.9e−16 |
| DAG_PE-bind | 1/1 | 451 | 497 ... | 1 | 51 [] | −6.5 | 0.81 |
| FYVE | 1/1 | 450 | 516 ... | 1 | 72 [] | 94.4 | 3.2e−25 |
| PH | 2/2 | 542 | 600 ... | 1 | 50 [. | 4.1 | 9.9 |

IPR000219: Dbl domain (dbl/cdc24 rhoGEF family); guanyl-nucleotide releasing factor (GO: 0008433) Guanine nucleotide exchange factor for Rho/Rac/Cdc42-like GTPases, also called Dbl-homologous (DH) domain. It appears that PF00169 (PH) domains invariably occur C-terminal to RhoGEF/DH domains.

IPR001849: PH domain (PF00169) The 'pleckstrin homology' (PH) domain is a domain of about 100 residues that occurs in a wide range of proteins involved in intracellular signaling or as constituents of the cytoskeleton
The function of this domain is not clear, several putative functions have been suggested: binding to the beta/gamma subunit of heterotrimeric G proteins, binding to lipids, e.g. phosphatidylinositol-4,5-bisphosphate, binding to phosphorylated Ser/Thr residues, and attachment to membranes by an unknown mechanism. It is possible that different PH domains have totally different ligand requirements.
The 3D structure of several PH domains has been determined. All known cases have a common structure consisting of two perpendicular anti-parallel beta sheets, followed by a C-terminal amphipathic helix. The loops connecting the beta-strands differ greatly in length, making the PH domain relatively difficult to detect.
There are no totally invariant residues within the PH domain.

IPR000306: FYVE Zn-finger, rabphilin/VPS27/FAB1 type
The FYVE zinc finger is named after four proteins that it has been found in: Fab1, YOTB/ZK632.12, Vac1, and EEA1. The FYVE finger has been shown to bind two Zn2 + ions (Stenmark et al., 1996, J. Biol. Chem. 271: 24048–24054). The FYVE finger has eight potential zinc coordinating cysteine positions. Many members of this family also include two histidines in a motif R + HHC + XCG, where + represents a charged residue and X any residue.

| PSSMs producing significant alignments: | | Score(bits) | Evalue |
|---|---|---|---|
| gnl\|Smart\|smart00325 | RhoGEF, Guanine nucleotide exchange factor for | 156 | 3e−39 |
| gnl\|Pfam\|pfam00621 | RhoGEF, RhoGEF domain. Guanine nucleotide exchange | 143 | 3e−35 |
| gnl\|Smart\|smart00064 | FYVE, Protein present in Fab1, YOTB, Vac1, and EEA1 | 93.2 | 4e−20 |
| gnl\|Pfam\|pfam01363 | FYVE, FYVE zinc finger. The FYVE zinc finger is | 89.0 | 8e−19 |
| gnl\|Smart\|smart00233 | PH, Pleckstrin homology domain.; Domain commonly | 62.0 | 1e−10 |
| gnl\|Smart\|smart00233 | PH, Pleckstrin homology domain.; Domain commonly | 46.2 | 6e−06 |
| gnl\|Pfam\|pfam00169 | PH, PH domain. PH stands for pleckstrin homology | 46.6 | 4e−06 |
| gnl\|Pfam\|pfam00169 | PH, PH domain. PH stands for pleckstrin homology | 39.3 | 7e−04 | gnl|Smart|smart00325, RhoGEF, Guanine nucleotide exchange factor for Rho/Rac/Cdc42-like GTPases; Guanine nucleotide exchange factor for Rho/Rac/Cdc42-like GTPases Also called Dbl-homologous (DH) domain. It appears that PH domains invariably occur C-terminal to RhoGEF/DH domains. Improved coverage. CD-Length = 181 residues, 85.1% aligned
gnl|Pfam|pfam00621, RhoGEF, RhoGEF domain. Guanine nucleotide exchange factor for Rho/Rac/Cdc42-like GTPases Also called Dbl-homologous (DH) domain. It appears that pfam00169 domains invariably occur C-terminal to RhoGEF/DH domains. CD-Length = 182 residues, 84.1% aligned
gnl|Smart|smart00064, FYVE, Protein present in Fab1, YOTB, Vac1, and EEA1; Zinc-binding domain, possibly involved in endosomal targetting. Recent data indicates that these domains bind PtdIns(3)P. CD-Length = 69 residues, 92.8% aligned
gnl|Pfam|pfam01363, FYVE, FYVE zinc finger. The FYVE zinc finger is named after four proteins that it has been found in: Fab1, YOTB/ZK632.12, Vac1, and EEA1. The FYVE finger has been shown to bind two Zn++ ions. The FYVE finger has eight potential zinc coordinating cysteine positions. Many members of this family also include two histidines in a motif R+HHC+XCG, where + represents a charged residue and X any residue. We have included members which do not conserve these histidine residues but are clearly related. CD-Length = 66 residues, 93.9% aligned

TABLE 10I-continued

Domain Analysis of NOV10 gnl|Smart|smart00233, PH, Pleckstrin homology domain.; Domain commonly found in eukaryotic sig-
nalling proteins. The domain family possesses multiple functions including the abilities to bind inositol
phosphates, and various proteins. PH domains have been found to possess inserted domains (such as in
PLC gamma, syntrophins) and to be inserted within other domains. Mutations in Brutons tyrosine
kinase (Btk) within its PH domain cause X-linked agammaglobulinaemia(XLA) in patients. Point muta-
tions cluster into the positively charged end of the molecule around the predicted binding site for phos-
phatidylinositol lipids. CD-Length = 104 residues, 99.0% aligned
gnl|Smart|smart00233, PH, Pleckstrin homology domain.; Domain commonly found in eukaryotic sig-
nalling proteins. The domain family possesses multiple functions including the abilities to bind inositol
phosphates, and various proteins. PH domains have been found to possess inserted domains (such as in
PLC gamma, syntrophins) and to be inserted within other domains. Mutations in Brutons tyrosine
kinase (Btk) within its PH domain cause X-linked agammaglobulinaemia(XLA) in patients. Point muta-
tions cluster into the positively charged end of the molecule around the predicted binding site for phos-
phatidylinositol lipids. CD-Length = 104 residues, 97.1% aligned
gnl|Pfam|pfam00169, PH, PH domain. PH stands for pleckstrin homology. CD-Length = 100 residues,
99.0% aligned
gnl|Pfam|pfam00169, PH, PH domain. PH stands for pleckstrin homology. CD-Length = 100 residues,
98.0% aligned The disclosed NOV10 nucleic acid encoding a Faciogenital Dysplasia Protein-like protein includes the nucleic acid whose sequence is provided in Table 10A or 10C, or variant thereof, including a SNP, fragment, homology, analog of the sequence is provided in Table 10A or 10C. The invention also includes a mutant or variant nucleic acid any of whose bases may be changed from the corresponding base shown in Table 10A while still encoding a protein that maintains its Faciogenital Dysplasia Protein-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 18% of the bases may be so changed of NOV10a and up to about 20% of the bases may be so changed of NOV10b.

The disclosed NOV10 protein of the invention includes the Faciogenital Dysplasia Protein-like protein whose sequence is provided in Table 10B or 10D. The invention also includes a mutant or variant protein any of whose residues may be changed from the corresponding residue shown in Table 10B or 10D while still encoding a protein that maintains its Faciogenital Dysplasia Protein-like activities and physiological functions, or a functional fragment thereof. In the mutant or variant protein, up to about 18% of the residues may be so changed of NOV10a and up to about 19% of the residues may be so changed of NOV10b.

The invention further encompasses antibodies and antibody fragments, such as $F_{ab}$ or $(F_{ab})_2$, that bind immunospecifically to any of the proteins of the invention. Also encompassed within the invention are peptides and polypeptides comprising sequences having high binding affinity for any of the proteins of the invention, including such peptides and polypeptides that are fused to any carrier partcle (or biologically expressed on the surface of a carrier) such as a bacteriophage particle.

This novel protein is similar to the faciogenital dyplasia protein (FGD1) that was first found in patients suffering from Aarskog-Scott syndrome. These individuals show ocular hypertelorism, anteverted nostrils, broad upper lip, peculiar penoscrotal relations ('saddle-bag scrotum' or 'shawl scrotum'), hyperextensibility of the fingers, genu recurvatum, flat feet, cryptorchidism, digital contractures, sternal deformity and osteochondritis dissecans at multiple sites and various skeletal defects. (Aarskog D, J. Pediatr.; 1970; 77(5):856–61; Scott, Birth Defects Orig. Art. Ser.; 1971 VII(6): 240–246, Berry et. al., 1980, Arch. Dis. Child.; 55: 706–710; Gorski et. al.; Dev. Dyn.; 2000 August; 218(4):573–86). The FGD1 gene which is associated with this syndrome has been shown to have two allelic variants; one of which is an insertion mutation in the FGD1 gene that results in a frameshift predicted to cause premature translation termination at codon 469 (Pasteris, Cell 79: 669–678, 1994) and the second results in an arg610-to-gln change in the protein product due to a G to A transition in exon 10 of the FGD1 gene (Orrico et.al., FEBS Lett. 478: 216–220, 2000).

This protein has a guanine nucleotide exchange factor (GEF) domain that regulates GTP binding protein signaling and a pleckstrin homology (PH) domain. The GEF domain regulates positively the signaling cascades that utilize GTP-binding proteins (such as those of the ras superfamily) that function as molecular switches in fundamental events such as signal transduction, cytoskeleton dynamics and intracellular trafficking. The PH domain is a domain of about 100 residues that occurs in a wide range of proteins involved in intracellular signaling or as constituents of the cytoskeleton. It may be regulate signal transduction as different PH domains might have different ligand requirements. A number of molecules intimately involved in signal transduction such as phosphatidylinositol-specific phospholipase C isoforms gamma and delta, the beta-adrenergic receptor kinases, the mu isoform of PKC, the oncogenes vav and dbl as well as insulin receptor substrate 1 (IRS-1) have been shown to have PH domains. Experiments have shown that the GEF and (PH) domains of FGD1 can bind specifically to the Rho family GTPase Cdc42Hs and stimulates the GDP-GTP exchange of the isoprenylated form of Cdc42Hs. Microinjection of a FGD1 polypeptide containing these domains into Swiss 3T3 fibroblast cells induces the formation of peripheral actin microspikes. These effects can be blocked by a dominant negative mutant of Cdc42; suggesting that FGD1 is a Cdc42Hs-specific guanine-nucleotide exchange factor. The GEF domain has also been shown to activate 2 kinases involved in cell proliferation; the Jun NH2-terminal kinase and the p70 S6 kinase (Zheng et. al.;

J Biol Chem Dec. 27, 1996; 271(52):33169–72). Thus this novel protein may play an important role in normal development as well as disease. This class of molecules (GEFs) is also being considered as a good drug target for diacylglycerol and phorbol esters.

The faciogenital dysplasia protein disclosed in this invention is expressed in at least the following tissues: Adrenal Gland/Suprarenal gland, Bone Marrow, Hypothalamus, Lung, Spleen, Uterus, Peripheral Blood. This information was derived by determining the tissue sources of the sequences that were included in the invention including but not limited to SeqCalling sources, public EST sources, literature sources, and/or RACE sources. In addition, the sequence is predicted to be expressed in the following tissues because of the expression pattern of (GenBank-ID: gb:GenBank-ID:AF017368|acc:AF017368.1) a closely related {Mus musculus faciogenital dysplasia protein 2 (Fgd2) mRNA, complete cds homolog in species Mus musculus: mouse embryo, adipose tissue.

The protein similarity information, expression pattern, and map location for the faciogenital dysplasia protein-like protein and nucleic acid disclosed herein suggest that this faciogenital dysplasia protein may have important structural and/or physiological functions characteristic of the guanine nucleotide exchange factor family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from: faciogenital dysplasia (Aarskog-Scott syndrome, inflammatory diseases, cancers, trauma, regeneration (in vitro and in vivo), viral/bacterial/parasitic infections, adrenoleukodystrophy, congenital adrenal hyperplasia, endometriosis, fertility, hemophilia, hypercoagulation, idiopathic thrombocytopenic purpura, autoimmume disease, allergies, immunodeficiencies, transplantation, graft versus host disease, anemia, asthma, emphysema, scleroderma, ARDS, neurological diseases and other diseases, disorders and conditions of the like.

The NOV10 nucleic acids and proteins identified here may be useful in potential therapeutic applications implicated in (but not limited to) various pathologies and disorders as indicated herein. For example, a CDNA encoding the Faciogenital Dysplasia Protein-like protein NOV10 may be useful in gene therapy, and the Faciogenital Dysplasia Protein-like protein NOV10 may be useful when administered to a subject in need thereof. The NOV10 nucleic acid encoding Faciogenital Dysplasia Protein-like protein, and the Faciogenital Dysplasia Protein-like protein of the invention, or fragments thereof, may further be useful in diagnostic applications, wherein the presence or amount of the nucleic acid or the protein are to be assessed. Additional disease indications and tissue expression for NOV10 and NOV10 variants, if available, are presented in the Examples.

Based on the tissues in which NOV10 is most highly expressed, specific uses include developing products for the diagnosis or treatment of a variety of diseases and disorders associated therewith. Specific expression of NOV10 in normal and diseased tissues, if available, is shown in the Examples.

NOV10 nucleic acids and polypeptides are further useful in the generation of antibodies that bind immunospecifically to the novel NOV10 substances for use in therapeutic or diagnostic methods. These antibodies may be generated according to methods known in the art, using prediction from hydrophobicity charts, as described in the "Anti-NOVX Antibodies" section below. The disclosed NOV10 protein has multiple hydrophilic regions, each of which can be used as an immunogen. In one embodiment, a contemplated NOV10a epitope is from about amino acids 1 to 15. In another embodiment, a NOV10a epitope is from about amino acids 10 to 145. In additional embodiments, NOV10a epitopes are from about amino acids 155 to 345, from about amino acids 360 to 515 and from about amino acids 515 to 655. In one embodiment, a contemplated NOV10b epitope is from about amino acids 1 to 15. In another embodiment, a NOV10b epitope is from about amino acids 10 to 145. In additional embodiments, NOV10b epitopes are from about amino acids 155 to 345, from about amino acids 360 to 515 and from about amino acids 515 to 673. These novel proteins can be used in assay systems for functional analysis of various human disorders, which will help in understanding of pathology of the disease and development of new drug targets for various disorders.

NOV11

A disclosed NOV11 nucleic acid of 1086 nucleotides (also referred to as SC111743377_A) (SEQ ID NO:27) encoding a novel Steroid Dehydrogenase-like protein is shown in Table 11A. An open reading frame was identified beginning with an ATG initiation codon at nucleotides 59–61 and ending with a TAA codon at nucleotides 1022–1024. Putative untranslated regions upstream from the initiation codon and downstream from the termination codon are underlined and the start and stop codons are in bold in Table 11A.

TABLE 11A

NOV11 nucleotide sequence (SEQ ID NO:27)

<u>CAGAGTCACGGTGACTCATTCGGGGGTCGCCACACTTAGCCAAGCAAGGCGAACTTTG</u>ATGATCCTAGGG

GGTCTTGCTGAAAAGACTGGTAGTCTTTCTGCTGGAATTACCCACCTGQGAGGGTGGAGCCTACTGCTGC

CTTCATGGTGGGGAGTGGGTGGAGGTGCGCGTGCAGTGGGGGGAGCCGCCGCAGCAGGGCCGGGCGCTGG

GCGGGCTGCTCCGCTGGGTGGTGCAACAGATGGGATTGGAAAAGCCTACGCTGAAGAGTTAGCAAGCCGA

TABLE 11A-continued

NOV11 nucleotide sequence (SEQ ID NO:27)

GGTCTCAATATAATCCTGATTAGTCGGAACGAGGAGAAGTTGCAGGTTGTTGCTAAAGACATAGCCGACA

CGTACAAAGTGGAAACTGATATTATAGTTGCGGACTTCAGCAGCGGTCGTGAGATCTACCTTCCAATTCG

AGAAGCCCTGAAGGACAAAGACGTTGGCATCTTGGTAAATAACGTGGGTGTGTTTTATCCCTACCCGCAG

TATTTCACTCAGCTGTCCGAGGACAAGCTCTGGGACATCATAAATGTGAACATTGCCGCCGCTAGTTTGA

TGGTCCATGTTGTGTTACCGGGAATGGTGCAGAGAAAGAAAGGTGCCATCGTCACGATCTCTTCTGGCTC

CTGCTGCAAACCCACTCCTCAGCTGGCTGCATTTTCTGCTTCTAAGGCTTATTTAGACCACTTCAGCAGA

GCCTTGCAATATGAATATGCCTCTAAAGGAATCTTTGTACAGAGTCTAATCCCTTTCTATGTAGCCACCA

GCATGACAGCACCCAGCAACTTTCTGCACAGGTGCTCGTGGTTGGTGCCTTCGCCAAAAGTCTATGCACA

TCATGCTGTTTCTACTCTTGGGATTTCCAAAAGGACCACAGGATATTGGTCCCATTCTACTCGAGCTTGG

GAAGTCAACGCTGCAGTGAGCTGTGTTCACACCACTGTACTCCAGCCTGGCAACAAAGTGAGACCCCGTC

TCACCAAAAAAAAAAAAAAAAAAAGAGAGAGAGAGAGAACAGTAATCTTTAAATCTGTAACAATTTTTAAA

GCATTGGCAAAGACTATGTAAATTTCACTTCTAGGT

The Steroid Dehydrogenase-like NOV11 disclosed in this invention maps to chromosome 16.

A disclosed NOV11 polypeptide (SEQ ID NO:28) encoded by SEQ ID NO:27 has 321 amino acid residues and is presented in Table 11B using the one-letter code. NOV11 polypeptides are likely Type Ib (Nexo Ccyt) membrane proteins. Analysis of NOV11 with INTEGRAL software predicts a likelihood of −3.88 of having a transmembrane domain at residues 157–173 (156–174). The SignalP, Psort and/or Hydropathy results predict that NOV11 has a signal peptide and is likely to be localized to the plasma membrane with a certainty of 0.7000. In an alternative embodiment, NOV11 is likely to be localized to the microbody (peroxisome) with a certainty of 0.3677, or to the nucleus with a certainty of 0.3500, or to the endoplasmic reticulum membrane with a certainty of 0.2000. The most likely cleavage site for a NOV11 signal peptide is between amino acids 36 and 37, i.e., at the dash in the sequence GGG-GG.

In a search of sequence databases, it was found, for example, that the nucleic acid sequence of NOV11 has 388 of 617 bases (62%) identical to a gb:GENBANK-ID:RRU81186|acc:U81186.1 mRNA from Rattus norvegicus (smooth muscle-specific 17beta-hydroxysteroid dehydrogenase type 3 mRNA, complete cds). The full amino acid sequence of the protein of NOV11 was found to have 141 of 312 amino acid residues (45%) identical to, and 194 of 312 amino acid residues (62%) similar to, the 312 amino acid residue ptnr:SWISSPROT-ACC:057314 protein from Anas platyrhynchos (Domestic duck) (PUTATIVE STEROID DEHYDROGENASE SPM2 (EC 1.1.1.-)).

In a search of public sequence databases, NOV11 was found to have homology to the amino acid sequences shown in the BLASTP data listed in Table 11C.

TABLE 11B

NOV11 protein sequence (SEQ ID NO:28)

MILGGLAEKTGSLSAGITHLGGWSLLLPSWWGVGGGGGAVGGAAAAGPGAGRAAALGGATDGIGKAYAEE

LASRGLNIILISRNEEKLQVVAKDIADTYKVETDIIVADFSSGREIYLPIREALKDKDVGILVNNVGVFY

PYPQYFTQLSEDKLWDIINVNIAAASLMVHVVLPGMVERKKGAIVTISSGSCCKPTPQLAAFSASKAYLD

HFSRALQYEYASKGIFVQSLIPFYVATSMTAPSNFLHRCSWLVPSPKVYAHHAVSTLGISKRTTGYWSHS

TRAWEVKAAVSCVHTTVLQPGNKVRPRLTKKKKKKEREREQ

TABLE 11C

BLASTP results for NOV11

| Gene Index/ Identifier | Protein/Organism | Length (aa) | Identity (%) | Positives (%) | Expect |
|---|---|---|---|---|---|
| gi\|13899307\|ref\|NP_1 13651.1\|NM_031463) | steroid dehydrogenase-like [*Homo sapiens*] | 309 | 226/230 (98%) | 227/230 (98%) | e–129 |
| gi\|3913470\|sp\|O57314\| DHBX_ANAPL | PUTATIVE STEROID DEHYDROGENASE SPM2 | 312 | 133/289 (46%) | 183/289 (63%) | 8e–62 |
| gi\|7705855\|ref\|NP_05 7226.1\|(NM_016142) | steroid dehydrogenase homolog [*Homo sapiens*] | 312 | 119/278 (42%) | 173/278 (61%) | 3e–56 |
| gi\|14770787\|ref\|XP_0 29897.1\|(XM_029897) | steroid dehydrogenase homolog [*Homo sapiens*] | 272 | 116/271 (42%) | 170/271 (61%) | 1e–55 |
| gi\|7298352\|gb\|AAF535 80.1\|(AE003652) | CG13284 gene product [*Drosophila melanogaster*] | 339 | 108/266 (40%) | 166/266 (61%) | 2e–53 |

A multiple sequence alignment is shown in Table 11D, with the protein of the invention being shown on the first line in a ClustalW analysis comparing the protein of the invention with related protein sequences shown in Table 11C.

TABLE 11D

ClustalW Analysis of NOV11

1) NOV11 SC111743377_A (SEQ ID NO:28)
2) gi|13899307| (SEQ ID NO:103)
3) gi|3913470| (SEQ ID NO:104)
4) gi|7705855| (SEQ ID NO:105)
5) gi|14770787| (SEQ ID NO:106)
6) gi|7298352| (SEQ ID NO:107)

```
                                 10        20        30        40        50
                        ....|....|....|....|....|....|....|....|....|....|
NOV11 SC111743377_A     --------------------MILGGLAEKTGSLSAGITHLGGWSLLLPSWW
gi|138 9307|            - -----------------MEALALVGAWYTARKSITVICDFYSLIRLHF
gi|3913470|             - ---------------MLPAAGLIWWVGALGALYAAVRGALGLLGALR
gi|770 855|             - -------------MESALPAAGFIYWVGAGYVAYLALRISYSLFTALR
gi|147 0787|            - ----------------------------------MRX---------
gi|7298352|             MQPVLEVSIYTLLKMAFIWQLISAAIYLVGLLTIGVFLYDNLKSLVSIIK 60        70        80        90       100
                        ....|....|....|....|....|....|....|....|....|....|
NOV11 SC111743377_A     GVGGGGAVGG-AAAAGPGAGRAAALGGATDGIGKAYAEELASRGLNIIL
gi|13899307|            IP-----RLGS-RADLIKQYGRWAVVSGARDGIGKAYAEELASRGLNIIL
gi|3913470|             VWG-----IGAGRAALGPGLGAWAVVTGATDGIGKAYARELAKHGMKVAL
gi|7705855|             VWG-----VGN-EAGVGPGLGEWAVVTGSTDGIGKSYAEELAKHGMKVVL
gi|14770787|            --------------GVGPGLGEWAVVTGSTDGIGKSYAEELAKHGMKVVL
gi|7298352|             AVKEP-YFQPHLPRTLVDKFGQWAVVTGATDGIGKEYARLARQGINLVL 110       120       130       140       150
                        ....|....|....|....|....|....|....|....|....|....|
NOV11 SC111743377_A     ISRNEEKLQVVAKDIADTYKVETDILVADFSSGREIYLPIREALKDKDVG
gi|13899307|            ISRNEEKLQVVAKDIADTYKVETDILVADFSSGREIYLPIREALKDKDVG
gi|3913470|             ISRSKEKLDQVAGEITEQVGVEIEVIVADFGEREDIYDRLRAGLEGLEIG
gi|7705855|             ISRSKDKLDQVSSEIKEKFKVETRTIAVDFAS-EDIYDKIKTGLAGLEIG
gi|14770787|            ISRSKDKLDQVSSEIKEKFKVETRTIAVDFAS-EDIYDKIKTGLAGLEIG
gi|7298352|             ISRTKEKLIAVTNEIESQYKVRIKWIAADFAKGREVYDQIEKELAGIDVG 160       170       180       190       200
                        ....|....|....|....|....|....|....|....|....|....|
NOV11 SC111743377_A     ILVNNVGVFYPYPQYFTQLS--EDKLWDIINVNIAAASLMVHVVLPGMVE
gi|13899307|            ILVNNVGVFYPYPQYFTQLS--EDKLWDIINVNIAAASLMVHVVLPGMVE
gi|3913470|             VLVNNVGISYSYPEYFIDVPDLDKTIDKMININIMSVCKMTRLVLPGMEE
gi|7705855|             ILVNNVGMSYEYPEYFLDVPDLDNVIKKMININILSVCKMTQLVLPGMVE
gi|14770787|            ILVNNVGMSYEYPEYFLDVPDLDNVIKKMININILSVCKMTQLVLPGMVE
gi|7298352|             ILVNNVGMMYEHPESLDLVS--EDLLWNLLTVMGSVYMLTRKRLPQMEG
```

TABLE 11D-continued

ClustalW Analysis of NOV11

```
                           210       220       230       240       250
                      ....|....|....|....|....|....|....|....|....|....|
NOV11 SC111743377_A   RKKGAIVTISSGSCCKETPQLAAFSASKAYLDHFSRALQYEYASKGIFVQ
gi|13899307|          RKKGAIVTISSGSCCKETPQLAAFSASKAYLDHFSRALQYEYASKGIFVQ
gi|3913470|           RSKGVILNISSAAGMYETPLLTYSSGLHAEYKSKGIIVQ
gi|7705855|           RSKGAILNISSGSGMLPVPLLTIYSATKTFVDFFSQCLHEEYRSKGVPVQ
gi|14770787|          RSKGAILNISSGSGMLPVPLLTIYSATKTFVDFFSQCLHEEYRSKGVPVQ
gi|7298352|           RRKGAIVNEGSSSELQELPNMLVYAASKKFVTYFSKALELEVAEHNIHVQ 260       270       280       290       300
                      ....|....|....|....|....|....|....|....|....|....|
NOV11 SC111743377_A   SLIPFYVATSMTAPSNFLHRCSWLVPSPKVYAHHAVSILGISKRTTGYWS
gi|13899307|          SLIPFYVATSMTAPSNFLHRCSWLVPSPKVYAHHAVSILGISKRTTGYWS
gi|3913470|           SVMPYYVATKMSKIS----KPSFDKPTPETYVRAAIGTVGLQSQTNGCLP
gi|7705855|           SVLPYFVATKLAKIR----KPTLDKPSPETFVKSAIKIVGLQSRTNGYLI
gi|14770787|          SVLPYFVATKLAKIR----KPILDKPSPETFVKSAIKIVGLQSRTNGYLI
gi|7298352|           LVMPNFVVTKMNAYIDRVMQGGLFFPNAYIPARSAVFTLGKTSETNGFWT 310       320       330       340
                      ....|....|....|....|....|....|....|....|...
NOV11 SC111743377_A   HSTRAWEVKAAVSCVHTTVIQPGNKVRPRLTKKKKKEREREQ
gi|13899307|          HSIQFLFAQYMPEWLWVWGAN-------ILNRSLRKEALSCTA
gi|3913470|           HAFMGWVFSILPTSTVMNLLMKTN--KQIRARFLKKKMKEK--
gi|7705855|           HALMGSIISNLPSQIYLKIVMNMN--KSTRAHYLKKTKKN---
gi|14770787|          HALMGSIISNLPSWIYLKIVMNMN--KSTRAHYLKKTKKN---
gi|7298352|           HGIQYAIMKLAELPIRTYLGHQLFKRLRIEALEQKQKKLKLT-
```

Other BLAST results include sequences from the Patp database, which is a proprietary database that contains sequences published in patents and patent publications. Patp results include those listed in Table 11E.

TABLE 11E

Patp BLASTP Analysis for NOV11

| Sequences producing High-scoring Segment Pairs | Protein/Organism | Length (aa) | Identity (%) | Positive (%) | E Value |
| --- | --- | --- | --- | --- | --- |
| patp: AAM39603 | Human polypeptide clone no: 2748 - Homo sapiens | 330 | 226/230 (98%) | 227/230 (98%) | 1.8e−117 |
| patp: AAM41389 | Human polypeptide clone no: 6320 - Homo sapiens | 340 | 226/230 (98%) | 227/230 (98%) | 1.8e−117 |
| patp: AAM93392 | Human polypeptide, clone no: 2984 - Homo sapiens | 330 | 226/230 (98%) | 227/230 (98%) | 1.8e−117 |
| patp: AAU18335 | Human endocrine polypeptide clone no: 290 - Homo sapiens | 315 | 213/217 (98%) | 214/217 (98%) | 1.3e−109 |
| patp: AAM42370 | Human polypeptide clone no: 103 - Homo sapiens | 265 | 179/183 (97%) | 180/183 (98%) | 5.1e−90 |

The presence of identifiable domains in the protein disclosed herein was determined by searches versus domain databases such as Pfam, PROSITE, ProDom, Blocks or Prints and then identified by the Interpro domain accession number. The results indicate that NOV11 contains the following protein domains (as defined by Interpro) at the indicated positions: short chain dehydrogenase domain (IPR002198) at amino acids 52 to 238; pfkB family carbohydrate kinase domain (IPR002173) at amino acids 36 to 205. This indicates that the sequence of the invention has properties similar to those of other proteins known to contain this/these domain(s) and similar to the properties of these domains. Table 11F lists the domain description from DOMAIN analysis results against NOV11.

TABLE 11F

Domain Analysis of NOV11

Pfam analysis

| PSSMs producing significant alignments: | Score (bits) | E value |
| --- | --- | --- |
| gnl\|Pfam\|pfam00106 adh_short, short chain dehydrogenase. This family contains a w . . . | 125 | 4e−30 |

TABLE 11F-continued

Domain Analysis of NOV11

```
gnl|Pfam|pfam00106, adh_short, short chain dehydrogenase. This family con-
tains
a wide variety of dehydrogenases.
         CD-Length = 249 residues, only 74.7% aligned
         Score=125 hits (314), Expect=4e-30
NOV11:   60 TDGIGKAYAEELASRGLNIILISRNEEKLQVVAKDIADT----YKVETDIIVADFSSGRE 115
            + ||| | |+ || | ++++ | ||| + |+ |+      ++ |  |  |  | +
Sbjct:   11 SSGIGLAIAKRLAEEGAKVVVVDRREEKAEAAAELKAELGDRALFIQLD--VTDEESIKA 68

NOV11:  116 IYLPIREALKDKDVGILVNNVGVFYPYPQYFTQLSEDKLWDIINVNIAAASLMVHVVLPG 175
            | |   ||  |||| |+  |       +||||     +|+||+    |+  |||
Sbjct:   69 AVAQAVEELGRLDV--LVNNAGILGPGE--PFELSEDDWERVIDVNLTGVFLLTQAVLPH 124

NOV11:  176 MVERKKGAIVTISSGSCCKPTPQLAAFSASKAYLDHFSRALQYEYASKGIFVQSLIPFYV 235
            |++|   | || ||| +    | | |+|+||||| +|||+|+|   |  || | ++ | |
Sbjct:  125 MLKRSGGRIVNISSVAGLVPSPGLSAYSASKAAVVGFTRSLALELAPHGIRVNAIAPGGV 184

NOV11:  236 ATSMTAPSNFLH (SEQ ID NO:257)                                 247
            |  ||      +
Sbjct:  185 DTDMTKALRSIA (SEQ ID NO:258)                                 196
```

The disclosed NOV11 nucleic acid encoding a steroid dehydrogenase-like protein includes the nucleic acid whose sequence is provided in Table 11A, or a fragment thereof. The invention also includes a mutant or variant nucleic acid any of whose bases may be changed from the corresponding base shown in Table 11A while still encoding a protein that maintains its steroid dehydrogenase-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 38% of the bases may be so changed.

The disclosed NOV11 protein of the invention includes the steroid-dehydrogenase-like protein whose sequence is provided in Table 11B. The invention also includes a mutant or variant protein any of whose residues may be changed from the corresponding residue shown in Table 11B while still encoding a protein that maintains its steroid-dehydrogenase-like activities and physiological functions, or a functional fragment thereof. In the mutant or variant protein, up to about 55% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle. Additional SNP variants of NOV11 are disclosed in Example 3.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV11 protein has multiple hydrophilic regions, each of which can be used as an immunogen. In one embodiment, a contemplated NOV11 epitope is from about amino acids 1 to 10. In another embodiment, a contemplated NOV11 epitope is from about amino acids 65 to 70. In other specific embodiments, contemplated NOV11 epitopes are from about amino acids 75 to 81, from about amino acids 88 to 98, from about amino acids 115 to 124, from about amino acids 141 to 154, from about amino acids 186 to 191, from about amino acids 200 to 206, from about amino acids 208 to 222, from about amino acids 247 to 258, from about amino acids 262 to 288, and from amino acids 297 to 321. These novel proteins can be used in assay systems for functional analysis of various human disorders, which will help in understanding of pathology of the disease and development of new drug targets for various disorders.

The Steroid Dehydrogenase disclosed in this invention is expressed in at least the following tissues: Adrenal Gland/Suprarenal gland, Bone, Bone Marrow, Brain, Dermis, Epidermis, Hair Follicles, Hippocampus, Hypothalamus, Kidney, Liver, Lymph node, Lymphoid tissue, Ovary, Peripheral Blood, Pituitary Gland, Placenta, Spleen, Testis, Thyroid, Uterus, Whole Organism. This information was derived by determining the tissue sources of the sequences that were included in the invention including but not limited to SeqCalling sources, Public EST sources, Literature sources, and/or RACE sources. Additional disease indications and tissue expression for NOV11 and NOV11 variants, if available, are presented in the Examples.

The protein similarity information, expression pattern, and map location for the Steroid Dehydrogenase-like protein and nucleic acid disclosed herein suggest that this Steroid Dehydrogenase may have important structural and/or physiological functions characteristic of the Dehydrogenase family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/ cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from: reproductive disorders, hypertension, neoplasia, digestive disorders, inflammation, as well as cancers which are hormonal in origin, namely breast, endometrium, ovary, prostate, testis, thyroid and osteosarcoma and other diseases, disorders and conditions of the like.

NOV12

A disclosed NOV12 nucleic acid of 2758 nucleotides (also referred to as 4418354_0_9_dal) (SEQ ID NO:29) encoding a novel SEC6-like protein is shown in Table 12A. An open reading frame was identified beginning with an ATG initiation codon at nucleotides 105–107 and ending with a TAG codon at nucleotides 2340–2342. Putative untranslated regions upstream from the initiation codon and downstream from the termination codon are underlined and the start and stop codons are in bold in Table 12A.

TABLE 12A

NOV12 nucleotide sequence (SEQ ID NO:29)

CGGCCGGAAGTGGCGGCGGCGGCGTCGGCGGCGGCGTAGCCGTAGAGGTGCACAGAGAACACCCCTAGCATGAACAG

TGTGAGGATTCCACCAGCTTTTTCACCATGAAGGAGACAGACCGGGAGGCCGTTGCGACAGCAGTGCAAAGGGTTGC

TGGGATGCTCCAGCGCCCGGACCAGCTGGACAAGGTGGAGCAGTATCGCAGGAGAGAAGCGCGGAAGAAGGCCTCCG

TGGAGGCCAGATTGAAGGCCGCCATCCAGTCACAGTTGGACGGGGTGCGCACAGGCCTCAGCCAGCTCCACAACGCC

CTGAATGACGTCAAAGACATCCAGCAGTCGCTGGCAGACGTCAGCAAGGACTGGAGGCAGAGCATCAACACCATTGA

GAGCCTCAAGGACGTCAAAGACGCCGTGGTGCAGCACAGCCAGCTCGCCGCAGCCGTGGAGAACCTCAAGAACATCT

TCTCAGTGCCTGAGATTGTGAGGGAGACCCAGGACCTAATTGAACAAGGGGCACTCCTGCAAGCCCACCGGAAGCTG

ATGGACCTGGAGTGCTCCCGGGACGGGCTGATGTACGAGCAGTACCCCATGGACAGTGGCAACACGCGTGACATGAC

CCTCATCCATGGCTACTTTGGCAGCACGCAGGGGCTCTCTGATGAGCTGGCTAAGCAGCTGTGGATGGTGCTGCAGA

GGTCACTGGTCACTGTCCGCCGTGACCCCACCTTGCTGGTCTCAGTTGTCAGGATCATTGAAAGGGAAGAGAAAATT

GACAGGCGCATACTTGACCGGAAAAAGCAAACTGGCTTTGTTCCTCCTGGGAGGCCCAAGAATTGGAAGGAGAAAAT

GTTCACCATCTTGGAGAGGACTGTGACCACCAGAATTGAGGGCACACAGGCAGATACCAGAGAGTCTGACAAGATGT

GGCTTGTCCGCCACCTGGAAATTATAAGGAAGTACGTCCTGGATGACCTCATTGTCGCCAAAAACCTGATCGTTCAG

TGCTTTCCTCCCCACTATGAGATCTTTAAGAACCTCCTGAACATGTACCACCAAGCCCTGAGCACGCGGATGCAGGA

CCTCGCATCGGAAGACCTGGAAGCCAATGAGATCGTGAGCCTCTTGACGTGGGTCTTAAACACCTACACAAGTACTG

AGATGATGAGGAACGTGGAGCTGGCCCCGGAAGTGGATGTCGGCACCCTGGAGCCATTGCTTTCTCCACACGTGGTC

TCTGAGCTGCTTGACACGTACATGTCCACGCTCACTTCAAACATCATCGCCTGGCTGCGGAAAGCGCTGGAGACAGA

CAAGAAAGACTGGGTCAAAGAGACAGAGCCAGAAGCCGACCAGGACGGGTACTACCAGACCACACTCCCTGCCATTG

TCTTCCAGATGTTTGAACAGAATCTPCAAGTTGCTGCTCAGATAAGTGAAGATTTGAAAACAAAGGTACTAGTTTTA

TGTCTTCAGCAGATGAATTCTTTCCTAAGCAGATATAAAGATGAAGCGCAGCTGTATAAAGAAGAGCACCTGAGGAA

TCGGCAGCACCCTCACTGCTACGTTCAGTACATGATCGCCATCATCAACAACTGCCAGACCTTCAAGGAATCCATAG

TCAGTTTAAAAAGAAAGTATTTAAAGAATGAAGTGGAAGAGGGTGTGTCTCCGAGCCAGCCCAGCATGACGGGATT

TTAGACGCCATCGCGAAGGAGGGCTGCAGCGGTTTGCTGGAGGAGGTCTTCCTGGACCTCGAGCAACATCTGAATGA

ATTGATGACGAAGAAGTCGCTATTAGGGTCAAACGCTGTAGACATTATCTGTGTCACCGTGGAAGACTATTTCAACG

ATTTTGCCAAAATTAAAAAGCCGTATAAGAAGAGGATGACGGCCGAGGCGCACCGGCGCGTGGTGGTGGAGTACCTG

CGGGCGGTCATGCAGAAGCGCATTTCCTTCCGGAGCCCGGAGGAGCGCAAGGAGGGTGCCGAGAAGATGGTTAGGGA

GGCAGAGCAGCGGCGCTTCCTGTTCCGGAAGCTGGCGTCCCGTTTCGGGGAAGACGTGGACGGATACTGCGACACCA

TCGTGGCTGTGGCCGAAGTGATCAAGCTGACAGACCCTTCTCTGCTCTACCTGGAGGTCTCCACTCTGGTCAGCAAG

TATCCAGACATCAGGGATGACCACATCGGTGCGCTGCTGGCTGTGCGTGGGGACGCCAGCCGTGACATGAAGCAGAC

CATCATGGAGACCCTGGAGCAGGGCCCAGCACAGGCCAGCCCCAGCTACGTGCCCCTCTTCAACGACATTGTGGTGC

TABLE 12A-continued

NOV12 nucleotide sequence (SEQ ID NO:29)

CCAGCCTGAACGTGGCCAAGCTGCTCAAGTAGCCTCCGCCGGCCTGCCCTGCTCGCCCCTCCACAGCCTCCGTCCCT

GCCTTTAGAAACGCGGGACAGCTGATTGCTCTCCTTGGCCACACGTGCTCCTTTTAGCTGCACGGCCTGTCTTTAGG

TGCCAGTGTGATGCACCGGGTGTGCGTCGAGTGAGCGTCCCGAGGCCACGTGCGCAGGCCCCTCACTGTGCTGTCAA

AGGCCTGTCGGTGCAGGGCTCTGCCGCACAGCCTCTCTTGGGTGCTTGTTTGTTGCAGTGGTTGAAAGTGTGTGGGG

CACAGAGGACGTGCACCTCCCTGCCCTCCTCCTCCCTGGGCCTTCACCGCACCCCATCTGCTTAAGTGCTCGGAACC

CCGTCACCTAATTAAAGTTTCTCGGCTTCCTCAGAGAAAAAAAAAAAAAAAAAAAAAAAAAAAA

The first 1.4 kb fragment of the SEC6-like NOV12 disclosed in this invention maps to both chromosome 4 (GENBANK-ID:AC060789, *Homo sapiens* chromosome 4 clone CTD-2015P5) and 8 (GENBANK-ID:AC061974, *Homo sapiens* chromosome 18 clone CTD-2010K22).

A disclosed NOV12 polypeptide (SEQ ID NO:30) encoded by SEQ ID NO:29 has 745 amino acid residues and is presented in Table 12B using the one-letter code. The Psort and Hydropathy results predict that this sequence has no signal peptide and is likely to be localized in the mitochondrial matrix space with a certainty of 0.4417 predicted by PSORT. In an alternative embodiment, NOV12 is likely to be localized to the microbody (peroxisome) with a certainty of 0.3000, or to the mitochondrial inner membrane with a certainty of 0.1277, or to the mitochondrial intermembrane space with a certainty of 0.1277.

In a search of sequence databases, it was found, for example, that the nucleic acid sequence of NOV12 has 2459 of 2463 bases (99%) identical to a gb:GENBANK-ID:AR087892|acc:AR087892.1 Mrna from Unknown. (Sequence 2 from U.S. Pat. No. 5,989,818). The full amino acid sequence of the protein of NOV12 was found to have 706 of 745 amino acid residues (94%) identical to, and 725 of 745 amino acid residues (97%) similar to, the 755 amino acid residue ptnr:SPTREMBL-ACC:Q62825 protein from *Rattus norvegicus* (RSEC6).

In a search of public sequence databases, NOV12 was found to have homology to the amino acid sequences shown in the BLASTP data listed in Table 12C.

TABLE 12B

NOV12 protein sequence (SEQ ID NO:30)

MKETDREAVATAVQRVAGMLQRPDQLDKVEQYRRREARKKASVEARLKAAIQSQLDGVRTGLSQLHNALN

DVKDIQQSLADVSKDWRQSINTIESLKDVKDAVVQHSQLAAAVENLKNIFSVPEIVRETQDLIEQGALLQ

AHRKLMDLECSRDGLMYEQYRNDSGNTRDMTLIHGYFGSTQGLSDELAKQLWMVLQRSLVTVRRDPTLLV

SVVRIIEREEKIDRRILDRKKQTGFVPPGRPKNWKEKMFTILERTVTTRIEGTQADTRESDKMWLVRHLE

IIRKYVLDDLIVAKNLMVQCFPPHYEIFKNLLNMYHQALSTRMQDLASEDLEANEIVSLLTWVLNTYTST

EMMRNVELAPEVDVGTLEPLLSPHVVSELLDTYMSTLTSNIIAWLRKALETDKKDWVKETEPEADQDGYY

QTTLPAIVFQMFEQNLQVAAQISEDLKTKVLVLCLQQMNSFLSRYKDEAQLYKEEHLRNRQHPHCYVQYM

IAIINNCQTFKESIVSLKRKYLKNEVEEGVSPSQPSMDGILDAIAKEGCSGLLEEVFLDLEQHLNELMTK

KWLLGSNAVDIICVTVEDYFNDFAKIKKPYKKRMTAEAHRRVVVEYLRAVMQKRISFRSPEERKEGAEKM

VREAEQRRFLFRKLASGFCEDVDGYCDTIVAVAEVIKLTDPSLLYLEVSTLVSKYPDIRDDHIGALLAVR

GDASRDMKQTIMETLEQGPAQASPSYVPLFKDIVVPSLNVAKLLK

TABLE 12C

BLASTP results for NOV12

| Gene Index/ Identifier | Protein/Organism | Length (aa) | Identity (%) | Positives (%) | Expect |
|---|---|---|---|---|---|
| gi\|1163174\| gb\|AAA85505.1\| (U32575) | similar to yeast Sec6p, sp\|P32844; similar to mammalian B94, sp\|Q03169; [*Rattus norvegicus*] | 755 | 706/745 (94%) | 725/745 (96%) | 0.0 |
| gi\|3005727\| gb\|AAC09358.1\| (AF055006) | sec6 homolog [*Homo sapiens*] | 471 | 470/471 (99%) | 470/471 (99%) | 0.0 |
| gi\|14721490\| ref\|XP_049569.1\| (XM_049569) | similar to *S. cerevisiae* Sec6p and *R. norvegicus* rsec6 [*Homo sapiens*] | 449 | 448/449 (99%) | 448/449 (99%) | 0.0 |
| gi\|16184243\| gb\|AAL13778.1\| (AY058549) | LD24661p [*Drosophila melanogaster*] | 738 | 284/738 (38%) | 438/738 (58%) | e−132 |
| gi\|7302583\| gb\|AAF57664.1\| (AE003799) | CG5341 gene product [*Drosophila melanogaster*] | 681 | 266/738 (36%) | 402/738 (54%) | e−111 |

A multiple sequence alignment is shown in Table 12D, with the protein of the invention being shown on the first line in a ClustalW analysis comparing the protein of the invention with related protein sequences shown in Table 12C.

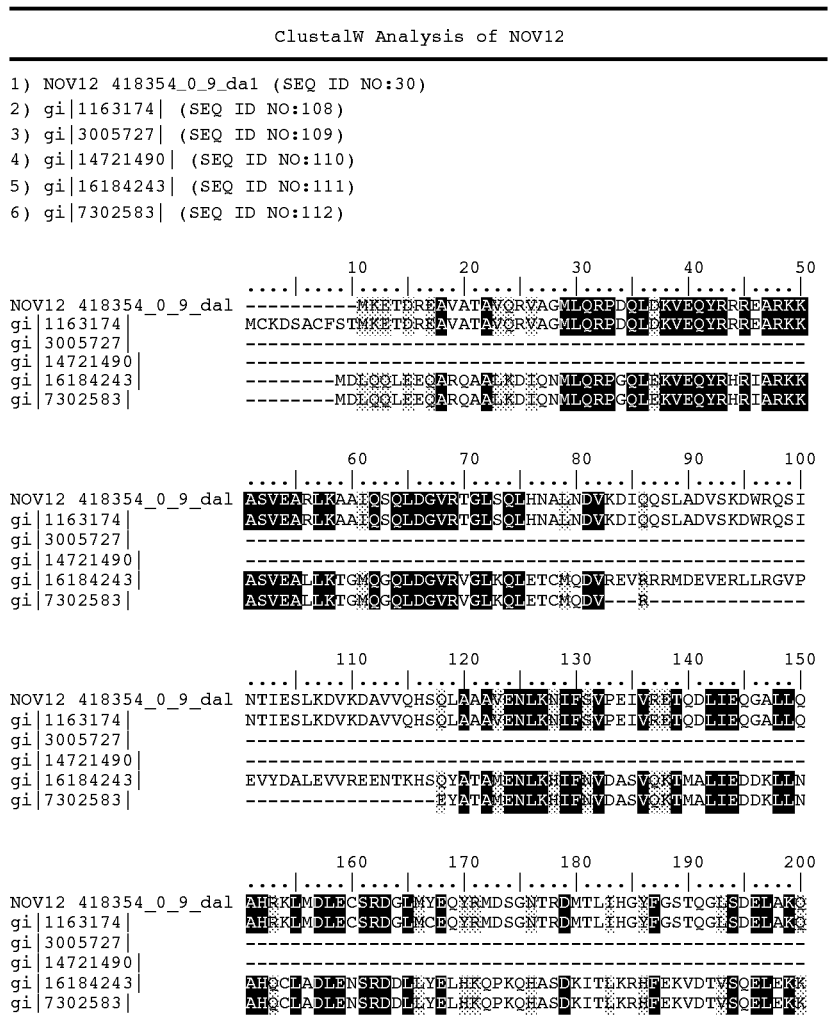

TABLE 12D

TABLE 12D-continued

ClustalW Analysis of NOV12

```
                         210       220       230       240       250
                    ....|....|....|....|....|....|....|....|....|....|
NOV12 418354_0_9_dal LWMVLQKSLVTVRRDPTLLVSVVRIIEREEKIDRRILDRKKQTGFVPPGR
gi|1163174|          LWMVLQKSLVTVRRDPTLLVSVVRIIEREEKIDRRILDRKKQTGFVPPGR
gi|3005727|          --------------------------------------------------
gi|14721490|         --------------------------------------------------
gi|16184243|         LRLILSKTLNTLRKKPTIIVTALRIIEREEKNDQFALQQQKVTGFVPPGR
gi|7302583|          LRLILSKTLNTLRKKPTIIVTALRIIEREEKNDQFALQQQ----------

260       270       280       290       300
                    ....|....|....|....|....|....|....|....|....|....|
NOV12 418354_0_9_dal PKNWKEKMFTILERTVTRIEGTQADTRESDKMWLVRHLEIIRKYVLRDL
gi|1163174|          PKNWKEKMFTILERTVTRIEGTQADTRESDKMWLVRHLEIIRKYVLRDL
gi|3005727|          ----------------------------LVRHLEIIRKYVLRDL
gi|14721490|         --------------------------------------------------
gi|16184243|         PKAWRRMIMDVLQQSVITRIEGSKLEERADNKMWLVRDLEILRQIILEDL
gi|7302583|          -------------K-SVITRIEGSKLEERADNKMWLVRDLEILRQIILEDL 310       320       330       340       350
                    ....|....|....|....|....|....|....|....|....|....|
NOV12 418354_0_9_dal IVAKNLMVQCFPPHYEIFKNLINMYHQALSTRMQDLASEDLEANEIVSLI
gi|1163174|          VIAKNLLVQCFPPHYEIFKNLLSMYHQALSIRMQDLASEDLEANEIVSLI
gi|3005727|          IVAKNLMVQCFPPHYEIFKNLINMYHQALSTRMQDLASEDLEANEIVSLI
gi|14721490|         ------MVQCFPPHYEIFKNLINMYHQALSTRMQDLASEDLEANEIVSLI
gi|16184243|         RVVKSLCVPCFPPHYQIFGEYVKFYHEGLSSYLDNIVRSGLEGNEYVSMM
gi|7302583|          RVVKSLCVPCFPPHYQIFGEYVKFYHEGLSSYLDNIVRSGLEGNEYVSMM 360       370       380       390       400
                    ....|....|....|....|....|....|....|....|....|....|
NOV12 418354_0_9_dal TWVLNTYTSTEMMRNVELAPEVDVGTLEPLLSPHVVSELLDTYMSTLTSN
gi|1163174|          TWVLNTYTSAEMMGNVELAPEVDVNALEPLLSPIVVSELLDTYMSTLTSN
gi|3005727|          TWVLNTYTSTEMMRNVELAPEVDVGTLEPLLSPHVVSELLDTYMSTLTSN
gi|14721490|         TWVLNTYTSTEMMRNVELAPEVDVGTLEPLLSPHVVSELLDTYMSTLTSN
gi|16184243|         AWVTHTYPGVELMSHPDLNVDVHR-QIGTLLRPEHLKALEDEYLQNMQRN
gi|7302583|          AWVTHTYPGVELMSHPDLNVDVHR-QIGTLLRPEHLKALEDEYLQNMQRN 410       420       430       440       450
                    ....|....|....|....|....|....|....|....|....|....|
NOV12 418354_0_9_dal IIAWLRKALETDKKDWVKETEPEADQEGYYQTTLFAIVFQMFEQNLQVAA
gi|1163174|          IIAWLRKALETDKKDWSKETEPEADQEGYYQTTLFAIVFQMFEQNLQVAA
gi|3005727|          IIAWLRKALETDKKDWVKETEPEADQEGYYQTTLFAIVFQMFEQNLQVAA
gi|14721490|         IIAWLRKALETDKKDWVKETEPEADQEGYYQTTLFAIVFQMFEQNLQVAA
gi|16184243|         FQEWMTKAAETEKQEWFTEIVPDQDEE-YYHTSAPVIIFQMIDQHLQVTN
gi|7302583|          FQEWMTKAAETEKQEWFTEIVPDQDEE-YYHTSAPVIIFQMIDQHLQVTN 460       470       480       490       500
                    ....|....|....|....|....|....|....|....|....|....|
NOV12 418354_0_9_dal QISEDLKTKVLVLCLQQMNSFLSRYKDEAQLYKEEHLRNRQHPHCYVQYM
gi|1163174|          QISEDLKTKVLVLCLQQMNSFLSRYKEEAQLYKEEHLRNRQHPHCYVQYM
gi|3005727|          QISEDLKTKVLVLCLQQMNSFLSRYKDEAQLYKEEHLRNRQHPHCYVQYM
gi|14721490|         QISEDLKTKVLVLCLQQMNSFLSRYKDEAQLYKEEHLRNRQHPHCYVQYM
gi|16184243|         TIHQELTFKALVMSTQQVEILGQTYLKNVIELKEHLFRNRDQIKYFTHYI
gi|7302583|          TIHQELTFKALVMSTQQVEILGQTYLKNVIELKEHLFRNRDQIKYFTHYI 510       520       530       540       550
                    ....|....|....|....|....|....|....|....|....|....|
NOV12 418354_0_9_dal IAIINNCQTFKESIVSLKRKYLKNEVEEGVSPSQPSMDGILDAIAKEGCS
gi|1163174|          VAIINNCQTFKESILSLKRKYLKPETEESLCQSQPSMDGILDAIAKEGCS
gi|3005727|          IAIINNCQTFKESIVSLKRKYLKNEVEEGVSPSQPSMDGILDAIAKEGCS
gi|14721490|         IAIINNCQTFKESIVSLKRKYLKNEVEEGVSPSQPSMDGILDAIAKEGCS
gi|16184243|         TTIVNNSQQMVELAQQMKQLYWPKSRTEHYEDFER-LLATFQRIRAHAAS
gi|7302583|          TTIVNNSQQMVELAQQMKQLYWPKSRTEHYEDFER-LLATFQRIRAHAAS 560       570       580       590       600
                    ....|....|....|....|....|....|....|....|....|....|
NOV12 418354_0_9_dal GLLEEVFLDLEQHLNELMTKKWLLGSNAVDIICVTVEDYFNDFAKIKKPY
gi|1163174|          SLLEEVFLDLEQHLNELMTKKWMLGSNAVDIICVTVEDYFNDFAKIKKPY
gi|3005727|          GLLEEVFLDLEQHLNELMTKKWLLGSNAVDIICVTVEDYFNDFAKIKKPY
gi|14721490|         GLLEEVFLDLEQHLNELMTKKWLLGSNAVDIICVTVEDYFNDFAKIKKPY
gi|16184243|         YLLEEAFLDMECHFNDLFTAKWLASNIAVDTICVTLDDYEQDYNHLRPNN
gi|7302583|          YLLEEAFLDMECHFNDLFTAKWLASNIAVDTICVTLDDYEQDYNHLRPNN
```

TABLE 12D-continued

ClustalW Analysis of NOV12

```
                        610        620        630        640        650
                    ....|....|....|....|....|....|....|....|....|....|
NOV12 418354_0_9_dal KKRMTAEAHRRVVVEYLRAVMQKRISFRSPEERKEGAEKMVTEAEQRRFL
gi|1163174|         KKRMTAEAHRRVVVEYLRAVMQKRISFRSAEERKEGAEKMVTEAEQLRFL
gi|3005727|         KKRMTAEAHRRVVVEYLRAVMQKRISFRSPEERKEGAEKMVTEAEQLRFL
gi|14721490|        KKRMTAEAHRRVVVEYLRAVMQKRISFRSPEERKEGAEKMVTEAEQLRFL
gi|16184243|        FEMVINEAQKLLAKRMIRALLSKRLSK-PRAECDAITRKIKTEAKRFKLF
gi|7302583|         FEMVINEAQKLLAKRYIRALLSKRLSK-PRAECDAITRKIKTEAKRFKLF 660        670        680        690        700
                    ....|....|....|....|....|....|....|....|....|....|
NOV12 418354_0_9_dal FRKLASGFGEDVDGYCDTIVAVAEVIKLTDPSLLYLEVSTLVSKYPDIRD
gi|1163174|         FRKLASGFGEDADGHCDTIVAVAEVIKLTDPSLLYLEVSTLVSKYPDIRD
gi|3005727|         FRKLASGFGEDVDGYCDTIVAVAEVIKLTDPSLLYLEVSTLVSKYPDIRD
gi|14721490|        FRKLASGFGEDVDGYCDTIVAVAEVIKLTDPSLLYLEVSTLVSKYPDIRD
gi|16184243|        FEKIAP--KISLSDSPLDLISTLSALLSSDIELLVLDLHTLEGSYESLNE
gi|7302583|         FEKIAP--KISLSDSPLDLISTLSALLSSDIELLVLDLHTLEGSYESLNE 710        720        730        740        750
                    ....|....|....|....|....|....|....|....|....|....|
NOV12 418354_0_9_dal DHIGALLAVRGDASR-DMKQTIMETLEQGPAQASPSYVPLLKDIVVPSLN
gi|1163174|         DHIGALLALRGDASR-DMKQTIMETLEQGPMQASPNYVPHLQEIVVPSLN
gi|3005727|         DHIGALLAVRGDASR-DMKQTIMETLEQGPAQASPSYVPLLKDIVVPSLN
gi|14721490|        DHIGALLAVRGDASR-DMKQTIMETLEQGPAQASPSYVPLLKDIVVPSLN
gi|16184243|        DHLVRLFYIRNDVKAAEVREKVQDAMKSKKAMVSIAKQDCIFKERVFSDK
gi|7302583|         DHLVRLFYIRNDVKAAEVREKVQDAMKSKKAMVSIAKQDCIFKERVFSDK ....|.
NOV12 418354_0_9_dal VAKLLK
gi|1163174|         VAKLLK
gi|3005727|         VAKLLK
gi|14721490|        VAKLLK
gi|16184243|        LW----
gi|7302583|         LW----
```

Other BLAST results include sequences from the Patp database, which is a proprietary database that contains sequences published in patents and patent publications. Patp results include those listed in Table 12E.

TABLE 12E

Patp BLASTP Analysis for NOV12

| Sequences producing High-scoring Segment Pairs | Protein/Organism | Length (aa) | Identity (%) | Positive (%) | E Value |
|---|---|---|---|---|---|
| patp: AAB43236 | Human ORFX ORF3000 polypeptide sequence clone no: 6000 - Homo sapiens | 757 | 745/745 (100%) | 745/745 (100%) | 0.0 |
| patp: AAY51115 | Human HSEC6 protein - Homo sapiens | 754 | 742/745 (99%) | 742/745 (99%) | 0.0 |
| patp: AAW69800 | Amino acid sequence of rsec6, a protein present in SA-17S complex - Rattus sp | 755 | 706/745 (94%) | 725/745 (97%) | 0.0 |
| patp: AAB49655 | Human SEC7 protein sequence clone no: 14 - Homo sapiens | 647 | 557/620 (89%) | 562/620 (90%) | 1.1e−284 |
| patp: AAB49654 | Human SEC6 protein sequence clone no: 12 - Homo sapiens | 365 | 301/364 (82%) | 306/364 (84%) | 8.3e−145 |

The presence of identifiable domains in the protein disclosed herein was determined by searches versus domain databases such as Pfam, PROSITE, ProDom, Blocks or Prints and then identified by the Interpro domain accession number. The results indicate that this protein contains the following protein domains (as defined by Interpro) at the indicated positions: domain name ATP-Synt_A-C (ATP Synthase Alpha Chain, C terminal) at amino acid positions 44 to 58, domain name biopterin_H (Biopterin-dependent aromatic amino acid) at amino acid positions 48 to 75. These two domains are also present in the Rat homolog RSEC6 (Q62825). This indicates that the sequence of the invention has properties similar to those of other proteins known to contain this/these domain(s) and similar to the properties of these domains. Table 12F lists the domain description from DOMAIN analysis results against NOV12.

TABLE 12F

Domain Analysis of NOV12

Pfam analysis
NO DOMAINS DETECTED

The disclosed NOV12 nucleic acid encoding a SEC6-like protein includes the nucleic acid whose sequence is provided in Table 12A, or a fragment thereof. The invention also includes a mutant or variant nucleic acid any of whose bases may be changed from the corresponding base shown in Table 12A while still encoding a protein that maintains its SEC6-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 1% of the bases may be so changed.

The disclosed NOV12 protein of the invention includes the SEC6-like protein whose sequence is provided in Table 12B. The invention also includes a mutant or variant protein any of whose residues may be changed from the corresponding residue shown in Table 12B while still encoding a protein that maintains its SEC6-like activities and physiological functions, or a functional fragment thereof. In the mutant or variant protein, up to about 6% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle. Additional SNP variants of NOV12 are disclosed in Examples.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV12 protein has multiple hydrophilic regions, each of which can be used as an immunogen. In one embodiment, a contemplated NOV12 epitope is from about amino acids 1 to 111. In another embodiment, a contemplated NOV12 epitope is from about amino acids 122 to 193. In other specific embodiments, contemplated NOV12 epitopes are from about amino acids 211 to 284, from about amino acids 305 to 333, from about amino acids 348 to 361, from about amino acids 394 to 428, from about amino acids 435 to 444, from about amino acids 460 to 488, from about amino acids 501 to 533, from about amino acids 544 to 561, from about amino acids 578 to 652, from about amino acids 682 to 725, and from about amino 738 to 745. These novel proteins can be used in assay systems for functional analysis of various human disorders, which will help in understanding of pathology of the disease and development of new drug targets for various disorders.

Based on the semi quantitative PCR, the SEC6 disclosed in this invention is ubiquitously expressed in the following tissues: Adrenal Gland, Thyroid, Salivary gland, Pituitary gland, Brain, Cerebral Cortex, Spinal cord, Heart, Skeletal Muscle, Bone marrow, Thymus, Spleen, Lymph node, Pancreas, Stomach, Small intestine, Bladder, Trachea, Kidney, Liver, Lung, Mammary gland, Ovary, Uterus, Placenta, Prostate, Testis at a measurably higher level than the following tissues: Adipose. Also the invention is expressed at an even higher level in the following cancer cell lines (compared to the expression level in the corresponding normal tissues): Breast cancer, CNS cancer, Colon cancer, Gastric cancer, Kidney cancer, Lung cancer, Liver cancer, Melanoma, Ovarian cancer, Pancreatic cancer, Prostate cancer. Additional disease indications and tissue expression for NOV12 and NOV12 variants, if available, are presented in the Examples.

The protein similarity information, expression pattern, and map location for the SEC6-like protein and nucleic acid disclosed herein suggest that this SEC6 may have important structural and/or physiological functions characteristic of the SEC family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, For example, the compositions of the present invention will have efficacy for treatment of patients suffering from: neurodegenerative disorders, and other diseases, disorders and conditions of the like. Also since the invention is expressed at a higher level in the following cancer cell lines including Breast cancer, CNS cancer, Colon cancer, Gastric cancer, Kidney cancer, Lung cancer, Liver cancer, Melanoma, Ovarian cancer, Pancreatic cancer, Prostate cancer, when compared to the corresponding normal tissues, it may be useful in diagnosis and treatment of these cancers.

NOV13

A disclosed NOV13 nucleic acid of 1609 nucleotides (also referred to as CG50179-01) (SEQ ID NO:31) encoding a novel Type II Cytokeratin-like protein is shown in Table 13A. An open reading frame was identified beginning with an ATG initiation codon at nucleotides 18–20 and ending with a TAG codon at nucleotides 1596–1598. Putative untranslated regions upstream from the initiation codon and downstream from the termination codon are underlined and the start and stop codons are in bold in Table 13A.

TABLE 13A

NOV13 nucleotide sequence (SEQ ID NO:31)

TTTCTGGCCTCCCCACCATGAGCCGCCAATTCACCTACAAGTCGGGAGCTGCTGCCAAGGGGGGCTTCAGCGGCTGCTCC

GCTGTGCTCTCAGGGGGCAGCTCATCCTCCTACCGAGCAGGGGGCAAAGGGCTCAGTGGAGGCTTCAGCAGTCGGAGCCT

TTACAGCCTGGGGGGTGCCCGGAGCATCTCTTTCAATGTGGCCAGTGGCAGTGGGTGGGCAGGAGGCTATGGATTTGGCC

GGGGCCGCGCCAGTGGCTTTGCTCGCAGCATGTTTGGCAGTGTGGCCTTGGGGTCCGTGTGTCCGTCGTTGTGCCCGCCC

GGGGGTATCCATCAGGTCACCATCAACAAGAGCCTCCTGGCACCCCTGAACGTGGAGCTGGACCCTGAAATCCAGAAAGT

GCGTGCCCAGGAGCGGGAGCAGATCAAGGTGCTGAACAACAAGTTCGCCTCCTTCATTGACAAGTGCGGTTCCTGGAGC

AGCAGAACCAGGTGCTGGAGACCAAGTGGGAGCTGCTACAGCAGCTGGACCTGAACAACTGCAAGAATAACCTGGAGCCC

ATCCTTGAGGGCTACATCAGCAACCTGCGGAAGCAGCTGGAGACGCTGTCTGGGGACAGGGTGAGGCTGGACTCGGAGCT

GAGCAGCGTGCGCGAAGTGGTGGAGGACTACAAGAAGAGGTATGAAGAAGAAATAAACAAGCGCACAACTGCTGAGAATG

AATTTGTGGTGCTTAAGAAGGACGTGGACGCAGCTTACACGAGCAAAGTGGAGCTCCAGGCCAAGGTGGATGCCCTGGAT

GGAGAAATCAAGTTCTTCAAGTGTTTGTTTCCCCTGCAGGAGACTGCTCAGATCCAGTCCCACATCAGCGACACGTCCAT

CATCCTGTCCATGGACAACAACCGGAACCTGGACCTGGACAGCATCATTGCTGAGGTCCGTGCCCAGTATGAGGAGATCG

CCCGGAAGAGCAAGGCCGAGGCCGAGGCCCTGTACCAGACCAAGTTCCAGGAGCTGCAGCTAGCAGCCGGCCGGCATGGG

GATGACCTGAAACACACCAAAAATGAGATCTCAGAGCTGACCCGTCTCATCCAAAGACTGCGCTCGGAGATTGAGAGTGT

GAAGAAGCAGTGTGCCAACCTGGAGACGGCCATCGCTGACGCCGAGCACCGGGGGGACTGTGCCCTCAAGGATGCCAGGG

CCAAGCTGGATGAGCTGGAGGGCGCCCTGCACCAGGCCAAGGAGGAGCTGGCACGGATGCTGCGCGAGTACCAGGAGCTC

ATGAGCCTGAAGCTGGCCCTGGACATGGAGATCGCCACCTATCGCAAGCTACTGGAGAGCGAGGAGTGCAGGATGTCAGG

AGAATTTCCCTCCCCTGTCAGCATCGCCATCATCAGCAGCACCAGTGGCGGCAGTGTCTATGGCTTCCGGCCCAGCATGG

TCAGCGGTGGCTATGTGGCCAACAGCAGCAACTGCATCTCTGGAGTGTGCAGCGTGAGAGGCGGGGAGGGCAGGAGCCGG

GGCAGTGCCAACGATTACAAAGACACCCTAGGGAAGGGTTCCAGCCTGAGTGCACCCTCCAAGAAAACCAGTCGGTAGAG

AAGACTGCC

The Type II Cytokeratin-like NOV13 disclosed in this invention maps to chromosome 12.

A disclosed NOV13 polypeptide (SEQ ID NO:32) encoded by SEQ ID NO:31 has 526 amino acid residues is presented in Table 13B using the one-letter code. The Psort and Hydropathy results predict that NOV13 has no signal peptide and is likely to be localized in the cytoplasm with a certainty of 0.4500 predicted by PSORT. In an alternative embodiment, NOV13 is likely to be localized to the microbody (peroxisome) with a certainty of 0.3000, or to the mitochondrial matrix space with a certainty of 0.1000, or to the lysosome lumen with a certainty of 0.1000.

TABLE 13B

NOV13 protein sequence (SEQ ID NO:32)

MSRQFTYKSGAAAKGGFSGCSAVLSGGSSSSYRAGGKGLSGGFSSRSLYSLGGARSISFNVASGSGWAGG

YGFGRGRASGFAGSMFGSVALGSVCPSLCPPGGIHQVTINKSLLAPLNVELDPEIQKVRAQEREQIKVLN

NKFASFIDKVRFLEQQNQVLETKWELLQQLDLNNCKNNLEPILEGYISNLRKQLETLSGDRVRLDSELRS

VREVVEDYKKRYEEEINKRTTAENEFVVLKKDVDAAYTSKVELQAKVDALDGEIKFFKCLFPLQETAQIQ

SHISDTSIILSMDNNRNLDLDSIIAEVRAQYEEIARKSKAEAEALYQTKFQELQLAAGRHGDDLKHTKNE

ISELTRLIQRLRSEIESVKKQCANLETAIADAEQRGDCALKDARAKLDELEGALHQAKEELARMLREYQE

LMSLKLALDMEIATYRKLLESEECRMSGEFPSPVSIAIISSTSGGSVYGFRPSMVSGGYVANSSNCISGV

CSVRGGEGRSRGSANDYKDTLGKGSSLSAPSKKTSR

In a search of sequence databases, it was found, for example, that the nucleic acid sequence of NOV13 has 1368 of 1601 bases (85%) identical to a gb:GENBANK-ID:AB033744|acc:AB033744.1 mRNA from *Mus musculus* (*Mus musculus* mRNA for type II cytokeratin, complete cds). The full amino acid sequence of the protein of NOV13 was found to have 459 of 526 amino acid residues (87%) identical to, and 490 of 526 amino acid residues (93%) similar to, the 524 amino acid residue ptnr:SPTREMBL-ACC:Q9R0H5 protein from *Mus musculus* (TYPE II CYTOKERATIN).

In a search of public sequence databases, NOV13 was found to have homology to the amino acid sequences shown in the BLASTP data listed in Table 13C.

TABLE 13C

BLASTP results for NOV13

| Gene Index/ Identifier | Protein/Organism | Length (aa) | Identity (%) | Positives (%) | Expect |
|---|---|---|---|---|---|
| gi\|15321302\|ref\| XP_053295.1\| (XM_053295) | keratin 6 irs [*Homo sapiens*] | 523 | 482/526 (91%) | 503/526 (94%) | 0.0 |
| gi\|9910294\|ref\| NP_064340.1\| (NM_019956) | keratin complex 2, gene 6 g [*Mus musculus*] | 524 | 459/526 (87%) | 490/526 (92%) | 0.0 |
| gi\|15321300\|ref\| XP_053294.1\| (XM_053294) | hypothetical protein XP_053294 [*Homo sapiens*] | 441 | 408/442 (92%) | 426/442 (96%) | 0.0 |
| gi\|7161776\|emb\| CAB76832.1\|(Y19212) | cytokeratin [*Homo sapiens*] | 551 | 285/482 (59%) | 368/482 (76%) | e-143 |
| gi\|4758618\|ref\| NP_004684.1\| (NM_004693) | cytokeratin type II [*Homo sapiens*] | 551 | 285/482 (59%) | 368/482 (76%) | e-143 |

A multiple sequence alignment is shown in Table 13D, with the protein of the inventin being shown on the first line in a ClustalW analysis comparing the protein of the invention with related protein sequences shown in Table 13C.

TABLE 13D

ClustalW Analysis of NOV13

1) NOV13 CG50179-01 (SEQ ID NO:32)
2) gi|15321302| (SEQ ID NO:113)
3) gi|9910294| (SEQ ID NO:114)
4) gi|15321300| (SEQ ID NO:115)
5) gi|7161776| (SEQ ID NO:116)
6) gi|4758618| (SEQ ID NO:117)

```
                              10        20        30        40        50
                      ....|....|....|....|....|....|....|....|....|....|
NOV13 CG50179_01      MSRQFIYKSGAAAKGGFSGCSAVLSGGSSSSYR--------AGGKGLS--
gi|15321302|          MSRQFIYKSGAAAKGGFSGCSAVLSGGSSSSFR--------AGGKGLS--
gi|9910294|           MSRQFIYKSGASNRG-FSGCSAVLSGGSSSSYR--------AGGKGLS--
gi|15321300|          --------------------------------------------------
gi|7161776|           MSRQSSITFQSGSRRGFSTTSAITPAAGRSRFSSVSVARSAAGSGGLGRI
gi|4758618|           MSRQSSITFQSGSRRGFSTTSAITPAAGRSRFSSVSVARSAAGSGGLGRI 60        70        80        90       100
                      ....|....|....|....|....|....|....|....|....|....|
NOV13 CG50179_01      ----GGFSSRSLYSLGCAESISFN-----VASGSGWAGGYGFGRGRASGR
gi|15321302|          ----GGFGSRSLYSLGCVR--SIN-----VASGSGKSGGYGFGRGRASGR
gi|9910294|           ----GGFGSRSLYSLGCGRSITIN-----MASGSGKNGGYGFGRNRASGR
gi|15321300|          --------------------------------------------------
gi|7161776|           SSAGASFGSRSLYNLGCAKRVSINGCGSSCRSGFGGRASNGFGVNSGFGY
gi|4758618|           SSAGASFGSRSLYNLGCAKRVSINGCGSSCRSGFGGRASNGFGVNSGFGY 110       120       130       140       150
                      ....|....|....|....|....|....|....|....|....|....|
NOV13 CG50179_01      ACSMFGSVALCSVCPSLCPPCGIHQVTINKSLLAPLNVELDPEIQKVRAQ
gi|15321302|          ACSMFGSVALCPVCPTVCPPCGIHQVTVNESLLAPLNVELDPEIQKVRAQ
gi|9910294|           ACSIFGSVALCPVCPAVCPPCGIHQVTVNESLLAPLNVELDPEIQKVRAQ
gi|15321300|          ---MFGSVALCPVCPTVCPPCGIHQVTVNESLLAPLNVELDPEIQKVRAQ
gi|7161776|           GGGVGGGFS-GPSFP-VCPPGGIQFVTVNQSLLTPLHLQIDPTIQRVRAE
gi|4758618|           GGGVGGGFS-GPSFP-VCPPGGIQFVTVNQSLLTPLHLQIDPTIQRVRAE
```

TABLE 13D-continued

ClustalW Analysis of NOV13

```
                         160        170        180        190        200
                    ....|....|....|....|....|....|....|....|....|....|
NOV13 CG50179_01    EREQIKVLNNKPASFIDKVRFLEQQNQVLETKWELLQQLDLNNCKNNLEP
gi|15321302|        EREQIKALNNKPASFIDKVRFLEQQNQVLETKWELLQQLDLNNCKNNLEP
gi|9910294|         EREQIKALNNKPASFIDKVRFLEQQNQVLQTKWELLQQLDLNNCKNNLEP
gi|15321300|        EREQIKALNNKPASFIDKVRFLEQQNQVLETKWELLQQLDLNNCKNNLEP
gi|7161776|         EREQIKTLNNKPASFIDKVRFLEQQNKVLETKWALLQEQGSRTVRQNLEP
gi|4758618|         EREQIKTLNNKPASFIDKVRFLEQQNKVLETKWALLQEQGSRTVRQNLEP 210        220        230        240        250
                    ....|....|....|....|....|....|....|....|....|....|
NOV13 CG50179_01    ILEGYISNLTKQLETLSGDRVRLDSELRSVREVVEDYKKRYEEEINKRTT
gi|15321302|        ILEGYISNLTKQLETLSGDRVRLDSELRNVRDVVEDYKKRYEEEINKRTA
gi|9910294|         ILEGHISNMTKQLETLSGDRVRLDSELRNVRDVVEDYKKKYEEEINRRTA
gi|15321300|        ILEGYISNLTKQLETLSGDRVRLDSELRNVRDVVEDYKKRYEEEINKRTA
gi|7161776|         LFDSYISELRRQLESITTERGRLEAELRNMQDVVEDKVRYEDEINKRTA
gi|4758618|         LFDSYISELRRQLESITTERGRLEAELRNMQDVVEDKVRYEDEINKRTA 260        270        280        290        300
                    ....|....|....|....|....|....|....|....|....|....|
NOV13 CG50179_01    AENEFVVLKKDVDAAYTSKVELQAKVDALDGEIKFFKCLFPLQETAQIGS
gi|15321302|        AENEFVLKKDVDAAYANKVELQAKVESMDQEIKFFRCLF-EAEITQIQS
gi|9910294|         AENEFVLKKDVDAAYANKVELQAKVDTMDQDIKFFKCLF-PAEMAQIQS
gi|15321300|        AENEFVLKKDVDAAYANKVELQAKVESMDQEIKFFRCLF-EAEITQIQS
gi|7161776|         AENEFVALKKDVDAAYMNKVELTAKVKSLPEEINFIHSVF-DAELSQLQI
gi|4758618|         AENEFVALKKDVDAAYMNKVELTAKVKSLPEEINFSHSVF-DAELSQLQI 310        320        330        340        350
                    ....|....|....|....|....|....|....|....|....|....|
NOV13 CG50179_01    HISDTSIILSMDNNRNLDLDSIIAEVRAQYEEIARKSKAEAEALYQTKFQ
gi|15321302|        HISDMSVILSMDNNRNLDLDSIIDEVRTQYEEIALKSKAEAEALYQTKFQ
gi|9910294|         HISDMSVILSMDNNRNLDLDSIIDEVRAQYEEIALKSKAEAEALYQTKFQ
gi|15321300|        HISDMSGEIKFFKCLDEVRTQYEEIALKSKAEAEALYQTKFQ
gi|7161776|         QVGDTSVVLSMDNNRNLDLDSIIAEVKAQYEDIANRSRAEAESWYQTKYE
gi|4758618|         QVGDTSVVLSMDNNRNLDLDSIIAEVKAQYEDIANRSRAEAESWYQTKYE 360        370        380        390        400
                    ....|....|....|....|....|....|....|....|....|....|
NOV13 CG50179_01    ELQLAAGRHGDDLKHTKNEISELTRLIQRLRSEIESVKKQCANLETAIAD
gi|15321302|        ELQLAAGRHGDDLKNTKNEISELTRLIQRLRSEIENVKKQASNLETAIAD
gi|9910294|         ELQLAAGRHGDDLKNTKNEIGELTRFIQRLRSEIENAKKQASNLETAIAD
gi|15321300|        ELQLAAGRHGDDLKNTKNEISELTRLIQRLRSEIENVKKQASNLETAIAD
gi|7161776|         ELQVTAGRHGDDLRNTRQEISEMNRMIQRLRAEIDSVKKQCSSLQTAIAD
gi|4758618|         ELQVTAGRHGDDLRNTRQEISEMNRMIQRLRAEIDSVKKQCSSLQTAIAD 410        420        430        440        450
                    ....|....|....|....|....|....|....|....|....|....|
NOV13 CG50179_01    AEQRGECALKDARAKLDELEGALHQAKEELARMLTEYQELMSLKLALDME
gi|15321302|        AEQRGENALKDARAKLDELEGALHQAKEELARMLTEYQELMSLKLALDME
gi|9910294|         AEQRGESALKDARAKLDELEGALHQAKEELARMLTEYQELMSLKLALDME
gi|15321300|        AEQRGENALKDARAKLDELEGALHQAKEELARMLTEYQELMSLKLALDME
gi|7161776|         AEQRGELALKDARAKIVDLEEALQKAKQDMARELREYQELMNIKLALDVE
gi|4758618|         AEQRGELALKDARAKIVDLEEALQKAKQDMARELREYQELMNIKLALDVE 460        470        480        490        500
                    ....|....|....|....|....|....|....|....|....|....|
NOV13 CG50179_01    IATYRKLLESEECRMSGELPSPVSIAIISSTSGGSVYGFRPSMVSG----
gi|15321302|        IATYRKLLESEECRMSGELPSPVSISIISSTSGGSVYGFRPSMVSG----
gi|9910294|         IATYRKLLESEECRMSGEYSSPVSISIISSTSGGGYGFRPSTVSG----
gi|15321300|        IATYRKLLESEECRMSGELPSPVSISIISSTSGGSVYGFRPSMVSG----
gi|7161776|         IATYRKLLEGEECRISGEGVSPVNISVVTSTLSSG-YGRGSSIGGNLGL
gi|4758618|         IATYRKLLEGEECRISGEGVSPVNISVVTSTLSSG-YGRGSSIGGNLGL 510        520        530        540        550
                    ....|....|....|....|....|....|....|....|....|....|
NOV13 CG50179_01    GYVANSSNCISGVCSVRGGEGRSRGSANDYKDTLGKGSSLSAPSKKTSR-
gi|15321302|        GYVANSSNCISGVCSVRGGEGRSRGSANDYKDTLGKGSSLSAPSKKTSR-
gi|9910294|         GYVANSTSCISGVCSVRGGENRSRGSANDYKDTLIKGSSLSTPSKKGGR-
gi|15321300|        GYVANSSNCISGVCSVRGGEGRSRGSANDYKDTLGKGSSLSAPSKKTSR-
gi|7161776|         GGGSGYSFTTSGGHSLGAGLGGSGFSATSNRGLGCSGSSVKFVSTTSSSQ
gi|4758618|         GGGSGYSFTTSGGHSLGAGLGGSGFSATSNRGLGCSGSSVKFVSTTSSSQ

....|
NOV13 CG50179_01    -----
gi|15321302|        -----
gi|9910294|         -----
gi|15321300|        -----
gi|7161776|         KSYTH
gi|4758618|         KSYTH
```

Other BLAST results include sequences from the Patp database, which is a proprietary database that contains sequences published in patents and patent publications. Patp results include those listed in Table 13E.

TABLE 13E

Patp BLASTP Analysis for NOV13

| Sequences producing High-scoring Segment Pairs | Protein/Organism | Length (aa) | Identity (%) | Positive (%) | E Value |
| --- | --- | --- | --- | --- | --- |
| patp: AAY52398 | Human keratin KERT-2 - Homo sapiens | 551 | 316/544 (58%) | 403/544 (74%) | 3.1e-145 |
| Patp: AAY52397 | Human keratin KERT-1 - Homo sapiens | 546 | 283/483 (58%) | 358/483 (74%) | 3.0e-131 |
| Patp: AAB58755 | Breast and ovarian cancer associated antigen protein sequence clone no: 463 - Homo sapiens | 433 | 242/386 (62%) | 311/386 (80%) | 1.6e-118 |
| Patp: AAW23820 | Human sarcolectin - Homo sapiens | 469 | 254/446 (56%) | 327/446 (73%) | 6.1e-117 |
| Patp: AAY69289 | Amino acid sequence of a human sarcolectin (SCL) protein - Homo sapiens | 469 | 254/446 (56%) | 327/446 (73%) | 6.1e-117 |

The presence of identifiable domains in the protein disclosed herein was determined by searches versus domain databases such as Pfam, PROSITE, ProDom, Blocks or Prints and then identified by the Interpro domain accession number. The results indicate that this protein contains the following protein domains (as defined by Interpro) at the indicated positions: domain name bZIP (ZIP transcription factor) at amino acid positions 186 to 224 and at amino acid positions 349 to 381, domain name Transpose_8 (Transposase) at amino acid positions 300 to 376, domain name OEP (Outer membrane efflux protein) at amino acid positions 239 to 426, domain name filament (Intermediate filament proteins) at amino acid positions 131 to 445. This indicates that the sequence of the invention has properties similar to those of other proteins known to contain this/these domain(s) and similar to the properties of these domains. Table 13F lists the domain description from DOMAIN analysis results against NOV13.

TABLE 13F

Domain Analysis of NOV13

```
Pfam analysis                                                      Score    E
PSSMs producing significant alignments:                            (bits)   value gnl|Pfam|pfam00038 filament, Intermediate filament protein          303     1e-83
gnl|Pfam|pfam01576 Myosin_tail, Myosin tail. The myosin molecule is  42.4    7e-05
                   a multi-subun . . .
gnl|Pfam|pfam01576 Myosin_tail, Myosin tail. The myosin molecule is  39.7    4e-04
                   a multi-subun . . .

gnl|Pfam|pfam00038, filament, Intermediate filament protein.
CD-Length = 312 residues, 100.0% aligned
Score = 303 bits (777), Expect = 1e-83

NOV13:  131 QEREQIRVLNNKFASFIDKVRFLEQQNQVLETKWELLQQLDLNNCKNNLEPILEGYISNL  190  (SEQ ID NO:259)
            |+||++ ||++ ||+|||||||||||+ ||  | |+|     +  |  +  |   |
Sbjct:    1 NEKEQMQNLNDRLASYIDKVRFLEQQNKELEVKIEELRQ-KQAPSVSRLYSLYETEIEEL   59  (SEQ ID NO:260)

NOV13:  191 RKQLETLSGDRVRLDSELRSVREVVEDYKKRYEEEINKRTTAENEFVVLKKDVDAAYTSK  250
            |+|++ |+ +|  ||   |+ ++||    ||++|+||+|  |  |||+  |+|+|  ++
Sbjct:   60 RRQIDQLTNERARLQLEIDNLREAAEDFRKKYEDEINLRQEAENDLVGLRKDLDEATLAR  119
```

TABLE 13F-continued

Domain Analysis of NOV13

```
NOV13:  251 VELQAKVDALDGEIKFFKCLFPLQETAQIQSHISDTSIILSMDNNRNLDLDSIIAEVRAQ 310
            |+|+ ||++|   |++| |    +|  ++|+ | || | ||  | ||   + |+|||
Sbjct:  120 VDLENKVESLQEELEFLKKNHE-EEVKELQAQIQDTVN-VEMDAARKLDLTKALREIRAQ 177

NOV13:  311 YEEIARKSKAEAEALYQTKFQELQLAAGRHGDDLKHTKNEISELTRLIQRLRSEIESVKK 370
            ||||+|++ |||  |++| +||| ||  |+|+ |+  |  |+|  |  | |  |++|+|
Sbjct:  178 YEEIAKKNRQEAEEWYKSKLEELQTAAARNGEALRSAKEEITELRRQIQSLEIELQSLKA 237

NOV13:  371 QCANLETAIADAEQRGDCALKDARAKLDELEGALHQAKEELARMLREYQELMSLKLALDM 430
            |  |+||   +|+ |+| +  |+  +| + +|| |  | +|+|| |||||||| +|||||+
Sbjct:  238 QNASLERQLAELEERYELELRQYQALISQLEEELQQLREEMARQLREYQELLDVKLALDI 297

NOV13:  431 EIATYRKLLESEECR                                              445
            ||||||||||  || |
Sbjct:  298 EIATYRELLEGEESR                                              312
``` gnl|Pfam|pfam01576, Myosin_tail, Myosin tail. The myosin molecule is a multi-subunit
complex made up of two heavy chains and four light chains it is a
fundamental contractile protein found in all eukaryote cell types. This family
consists of the coiled-coil myosin heavy chain tail region. The coiled-coil is
composed of the tail from two molecules of myosin. These can then assemble into
the macromolecular thick filament. The coiled-coil region provides the structural
backbone the thick filament.
CD-Length = 860 residues, only 39.1% aligned
Score = 42.4 bits (98), Expect = 7e-05

```
NOV13:  126 QKVRAQEREQIKVLNNEFASFIDKVRFLEQQNQVLETK-WELLQQLD----LNNCKNNLE 180  (SEQ ID NO:261)
            +|   |  |+ |   |    ++ | |  |+++ +|+|+    + + |+
Sbjct:  179 EKKAKQLESQLSELQVKLDELQRQLNDLTSQKSRLQSENSDLTRQLEEAEAQVSNLSKLK 238  (SEQ ID NO:262)

NOV13:  181 PILEGYISNLRKQLETLSGDRVELDSELRSVREVVEDYKKRYEEEINKRTTAENEFVVLK 240
            ||  +  ++ ||  |+   | ++|| +   ++  +++  |||     +   |  | +
Sbjct:  239 SGLESQLEEAKRSLEEESRERANLQAQLRQLEHDLDSLREQLEEESEAKAELEEQLSKAN 298

NOV13:  241 KDVDAAYT--------------SKVELQAKVDALD--CEIKFFKCLFPLQETAQIQSHI 283
            ++   +         | +| |+ |+   |  |   + +++|| +
Sbjct:  299 AEIQQWRSKFESEGALRAEELEELKKKLNQKISELEEAAEAANAKCDSLEKTKSRLQSEL 358

NOV13:  284 SDTSIILSMDNNRNLDL-------DSIIAEVRAQYEEIARKSKAEAEALYQTKFQELQLA 336
             | | |    +|        | |+|| + + +|+      |+      |
Sbjct:  359 EDLQIELERANAAASELEKKQKNFDKILAEWKRKVDEL-----------QAELDTAQRE 406

NOV13:  337 AGRHGDDLKHTKNEISELTRLIQRLRSEIESVKKQCANLETAIADAEQRG---DCALKDA 393
            |    +|   |||+ ||   ++ ||  | ++++ +  +|   + +    + |
Sbjct:  407 ARNLSTELFRLKNELEELKDQVEALRRENKNLQDEIHDLTDQLGEGGRNVHELEKARRRL 466

NOV13:  394 RAKLDELEGALHQAKEELARMLREYQELMSLKLALDMEIATYRKLLESEE            443
            |+ |||+ || +|+ |      +  ||  +|  || ||
Sbjct:  467 EAEKDELQAALEEAEAALELEESEVLRAQVELSQIRSEIE--RRLAEKEE            514
``` gnl|Pfam|pfam01576, Myosin_tail, Myosin tail. The myosin molecule is a multi-
subunit complex made up of two heavy chains and four light chains it is a
fundamental contractile protein found in all eukaryote cell types. This family
consists of the coiled-coil myosin heavy chain tail region. The coiled-coil is
composed of the tail from two molecules of myosin. These can then assemble into
the macromolecular thick filament. The coiled-coil region provides the structural
backbone the thick filament.
CD-Length = 860 residues, only 24.3% aligned
Score = 39.7 bits (91), Expect = 4e-04

```
NOV13:  183 LEGYISNLRKQLETLSGDRVRLDSELRSVREVVEDYEKRYEEEINERTTAENEFVVLKKD 242  (SEQ ID NO:263)
            ||| |+ |  |+ +       ++ ++ |++ + + |||   |   |  + | | ++
Sbjct:  551 LEGDINELEIALDHANKANAEAQKNVKKYQQQVKELQTQVEEEQRAREDAREQLAVAERR 610  (SEQ ID NO:264)

NOV13:  243 VDAAYTSKVELQAKVDALDGEIKFFKCLFPLQETAQIQSHISDTSIILSMDNNRNLDLDS 302
            |    ||++ ++  +      |   |+  +++ +    +   |+
Sbjct:  611 ATALEAELEELESALEQAERARKQAE-----TELAEASERVNELTAQNSSLIAQKRKLEG 665

NOV13:  303 IIAEVRAQYEEIARKSKAEAEALYQTKFQELQLAAGRHGDDLKHTKNEISELTRLIQRLR 362
            +| +++ +|   + ||   + ++ |  |    | ||+ +      | | ++|
Sbjct:  666 ELAALQSDLDEAVNELKAAEE-----RAKKAQADAARLAEELRQEQEHSQHLERLRKQLE 720

NOV13:  363 SEIESVKKQCANLETAIADAEQRGDCALKDARAKLDELEGAL                   404
            |+++ ++ +   |+ | | |   ++  |++ |||  |
Sbjct:  721 SQVKELQVR---LDEAEAAALKGGKKMIQKLEARVRELEAEL                   759
```

The disclosed NOV13 nucleic acid encoding a Type II Cytokeratin-like protein includes the nucleic acid whose sequence is provided in Table 13A, or a fragment thereof. The invention also includes a mutant or variant nucleic acid any of whose bases may be changed from the corresponding base shown in Table 13A while still encoding a protein that maintains its Type II Cytokeratin-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 15% of the bases may be so changed.

The disclosed NOV13 protein of the invention includes the Type II Cytokeratin-like protein whose sequence is provided in Table 13B. The invention also includes a mutant or variant protein any of whose residues may be changed from the corresponding residue shown in Table 13B while still encoding a protein that maintains its Type II Cytokeratin-like activities and physiological functions, or a functional fragment thereof. In the mutant or variant protein, up to about 13% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV13 protein has multiple hydrophilic regions, each of which can be used as an immunogen. In one embodiment, a contemplated NOV13 epitope is from about amino acids 1 to 13. In another embodiment, a contemplated NOV13 epitope is from about amino acids 28 to 50. In other specific embodiments, contemplated NOV13 epitopes are from about amino acids 66 to 79, from about amino acids 116 to 260, from about amino acids 275 to 280, from about amino acids 287 to 295, from about amino acids 298 to 419, from about amino acids 433 to 451, and from about amino acids 490 to 526. These novel proteins can be used in assay systems for functional analysis of various human disorders, which will help in understanding of pathology of the disease and development of new drug targets for various disorders.

The Type II Cytokeratin disclosed in this invention is expressed in at least the following tissues: skin, muscle, bone, cartilage, colon carcinoma, and lung. This information was derived by determining the tissue sources of the sequences that were included in the invention including but not limited to SeqCalling sources, Public EST sources, Genomic Clone sources, Literature sources, and/or RACE sources.

In addition, the sequence is predicted to be expressed in the following tissues because of the expression pattern of (GENBANK-ID: gb:GENBANK-ID:AB033744 |acc:AB033744.1) a closely related {Mus musculus mRNA for type II cytokeratin, complete cds homolog in species Mus musculus:skin, muscle, bone, cartilage, colon carcinoma, and lung. Additional disease indications and tissue expression for NOV13 and NOV13 variants, if available, are presented in the Examples.

The protein similarity information, expression pattern, and map location for the Type II Cytokeratin-like protein and nucleic acid disclosed herein suggest that this Type II Cytokeratin may have important structural and/or physiological functions characteristic of the Keratin family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from inflammatory and infectious diseases such as AIDS, encephalomyelitis, neurodegenerative disorders, Alzheimer's Disease, Parkinson's Disorder, hematopoietic disorders, endocrine diseases, muscle disorders, wound repair, bacterial, fungal, protozoal and viral infections (particularly infections caused by HIV-1 or HIV-2), pain, cancer (including but not limited to Neoplasm; adenocarcinoma; lymphoma; prostate cancer; uterus cancer), anorexia, bulimia, asthma, allergies, acute heart failure, hypotension, hypertension, urinary retention, osteoporosis, Crohn's disease, multiple sclerosis, and treatment of Albright hereditary ostoeodystrophy, angina pectoris, myocardial infarction, ulcers, benign prostatic hypertrophy, and psychotic and neurological disorders, including anxiety, schizophrenia, manic depression, delirium, dementia, severe mental retardation and dyskinesias, such as Huntington's disease and/or other pathologies and disorders.

NOV14

A disclosed NOV14 nucleic acid of 876 nucleotides (also referred to as 95073892_da1) (SEQ ID NO:33) encoding a novel protein kinase SNF1LK-like protein is shown in Table 14A. An open reading frame was identified beginning with an ATG initiation codon at nucleotides 1–3 and ending with a TGA codon at nucleotides 874–876. The start and stop codons are in bold in Table 14A.

TABLE 14A

NOV14 nucleotide sequence (SEQ ID NO:33)

ATGGTTATCATGTCGGAGTTCAGCGCGGACCCCGCGGGCCAGGGTCAGGGCCAGCAGAAGCCCCTCCGGGTGGGTTT

TTACGACATCGAGCGGACCCTGGGCAAAGGCAACTTCGCGGTGGTGAAGCTGGCGCGGCATCGAGTCACCAAAACGC

AGGTTGCAATAAAAATAATTGATAAAACACGATTAGATTCAAGCAATTTGGAGAAAATCTATCGTGAGGTTCAGCTG

ATGAAGCTTCTGAACCATCCACACATCATAAAGCTTTACCAGGTTATGGAAACAAAGGACATGCTTTACATCGTCAC

TGAATTTGCTAAAAATGGAGAAATGTTTGATTATTTGACTTCCAACGGGCACCTGAGTGAGAACGAGGCGCGGAAGA

AGTTCTGGCAAATCCTGTCGGCCGTGGAGTACTGTCACGACCATCACATCGTCCACCGGGACCTCAAGACCGAGAAC

CTCCTGCTGGATGGCAACATGGACATCAAGCTGGCAGATTTTGGATTTGGGAATTTCTACAAGTCAGGAGAGCCTCT

GTCCACGTCGTGTCGGAGCCCCCCGTATGCCGCCCCGGAAGTCTTTGAGGGGAAGGAGTATGAAGGCCCCCAGCTCG

ACATCTGGAGCCTGGGCGTGGTGCTGTACGTCCTGGTCTGCGGTTCTCTCCCCTTCGATGGGCCTAACCTGCCGACG

CTGAGACAGCGGGTGCTGGAGGGCCGCTTCCGCATCCCCTTCTTCATGTCTCAAGACTGTGAGAGCCTGATCCGCCT

GGCCAGGCTGGCCCCAGGTTGTGAGCCCCTGGGGCTGCTGCAGGGGGACTCTGAGATGGGGGACCTGATGCCCTGCT

CCCTAGGCACGTTTGTCCTGGTGCAGTGA

---

The protein kinase SNF1LK-like NOV14 disclosed in this invention maps to chromosome 21.

A disclosed NOV14 polypeptide (SEQ ID NO:34) encoded by SEQ ID NO:33 has 291 amino acid residues and is presented in Table 14B using the one-letter code. NOV14 polypeptides are likely Type Ib (Nexo Ccyt) membrane proteins. Analysis of NOV14 with INTEGRAL software predicts a likelihood of −3.13 of having a transmembrane domain at residues 207–223 (203–226). The SignalP, Psort and/or Hydropathy as analyzed herein suggest that the PSORT is not always accurate in its prediction. Although Psort and/or hydropathy suggest that the protein kinase SNF1LK-like protein may be localized at the plasma membrane, SignalP shows that there is no signal peptide. The protein predicted here contains eukaryotic protein kinase domain, and is similar to the protein kinase SNF1LK family, members of which are expected to have intracellular sub-cellular localization. In addition, members of the Snf1/AMPK protein kinase family have been shown to be localized intracellularly (EMBO J 1999 Dec. 1; 18(23):6672–81). Therefore it is likely that this novel protein kinase SNF1LK-like protein is available at the same sub-cellular localization and hence accessible to a diagnostic probe and for various therapeutic applications. Nonetheless, the SignalP, Psort and/or Hydropathy results predict that NOV14 is likely to be localized to the plasma membrane with a certainty of 0.7000. In an alternative embodiment, NOV14 is likely to be localized to the microbody (peroxisome) with a certainty of 0.4599, or to the endoplasmic reticulum membrane with a certainty of 0.2000, or to the mitochondrial inner membrane with a certainty of 0.1000.

TABLE 14B

NOV14 protein sequence (SEQ ID NO:34)

MVIMSEFSADPAGQGQGQQKPLRVGFYDIERTLGKGNFAVVKLARHRVTKTQVAIKITDKTRLDSSNLEK

IYREVQLMKLLNHPHIIKLYQVMETKDMLYIVTEFAKNGEMFDYLTSNGHLSENEARKKFWQILSAVEYC

HDHHIVHRDLKTENLLLDGNNDIKLADFGFGNFYKSGEPLSTWCGSPPYAAPEVFEGKEYEGPQLDIWSL

GVVLYVLVCGSLPFDGPNLPTLRQRVLEGRFRTPFFMSQDCESLIRLARLAPGCEPLGLLQGDCEMCDLM

PCSLGTFVLVQ

---

In a search of sequence databases, it was found, for example, that the nucleic acid sequence of NOV14 has 828 of 871 bases (95%) identical to a gb:GENBANK-ID:AX024729|acc:AX024729.1 Mrna from *Homo sapiens* (Sequence 1 from Patent WO0017232). The full amino acid sequence of the protein of NOV14 was found to have 256 of 259 amino acid residues (98%) identical to, and 256 of 259 amino acid residues (98%) similar to, the 786 amino acid residue ptnr:SWISSNEW-ACC:P57059 protein from *Homo sapiens* (PROBABLE SERINE/THREONINE PROTEIN KINASE SNF1LK (EC 2.7.1.-)). The sequence of this invention lacks 492 amino acids (from positions 260 to 751), when compared to >ptnr:SWISSNEW-ACC:P57059 PROBABLE SERINE/THREONINE PROTEIN KINASE SNF1LK (EC 2.7.1.-)—*Homo sapiens*, 786 aa. The sequence of this invention has additional, smaller differences when compared to >ptnr:SWISSNEW-ACC:P57059 PROBABLE SERINE/THREONINE PROTEIN KINASE SNF1LK (EC 2.7.1.-)—*Homo sapiens*, 786 aa.

In a search of public sequence databases, NOV14 was found to have homology to the amino acid sequences shown in the BLASTP data listed in Table 14C.

TABLE 14C

BLASTP results for NOV14

| Gene Index/ Identifier | Protein/Organism | Length (aa) | Identity (%) | Positives (%) | Expect |
|---|---|---|---|---|---|
| gi\|9978891\| sp\|P57059\| SN1L_HUMAN | PROBABLE SERINE/THREONINE PROTEIN KINASE SNF1LK | 786 | 256/259 (98%) | 256/259 (98%) | e-151 |
| gi\|11067425\| ref\|NP_067725.1\| (NM_021693) | salt-inducible protein kinase [*Rattus norvegicus*] | 776 | 248/256 (96%) | 252/256 (97%) | e-148 |
| gi\|12643489\| sp\|Q9R1U5\| SN1L_RAT | PROBABLE SERINE/THREONINE PROTEIN KINASE SNF1LK (SALT-INDUCIBLE PROTEIN KINASE) (PROTEIN KINASE KID2) | 776 | 248/256 (96%) | 252/256 (97%) | e-148 |
| gi\|6754746\| ref\|NP_034961.1\| (NM_010831) | myocardial SNF1-like kinase [*Mus musculus*] | 779 | 243/256 (94%) | 250/256 (96%) | e-144 |
| gi\|6760436\|gb\| AAF28351.1\| AF219232_1 (AF219232) | qin-induced kinase [*Gallus gallus*] | 798 | 234/256 (91%) | 244/256 (94%) | e-139 |

A multiple sequence alignment is shown in Table 14D, with the protein of the invention being shown on the first line in a ClustalW analysis comparing the protein of the invention with related protein sequences shown in Table 14C.

TABLE 14D

ClustalW Analysis of NOV14

1) NOV14 95073892_dal (SEQ ID NO:34)
2) gi|9978891| (SEQ ID NO:118)
3) gi|11068425| (SEQ ID NO:119)
4) gi|12643489| (SEQ ID NO:120)
5) gi|6754746| (SEQ ID NO:121)
6) gi|6760436| (SEQ ID NO:122)

```
                               10        20        30        40        50
                       ....|....|....|....|....|....|....|....|....|....|
NOV14 95073892_dal     MVIMSEFSADPAGQGQGQQKPLRVGFYDIERTLGKGNFAVVKLARHRVTR
gi|9978891|            MVIMSEFSADPAGQGQGQQKPLRVGFYDIERTLGKGNFAVVKLARHRVTR
gi|11067425|           MVIMSEFSAVPTGTGQGQQKPLRVGFYDVERTLGKGNFAVVKLARHRVTR
gi|12643489|           MVIMSEFSAVPTGTGQGQQKPLRVGFYDVERTLGKGNFAVVKLARHRVTR
gi|6754746|            MVIMSEFSAVPSGTGQGQQKPLRVGFYDVERTLGKGNFAVVKLARHRVTR
gi|6760436|            MVIMSEDASVPAPS-AAQPRPLRVGFYDIERTLGKGNFAVVKLARHRVTR 60        70        80        90       100
                       ....|....|....|....|....|....|....|....|....|....|
NOV14 95073892_dal     TQVAIKIIDKTRLDSSNLEKIYREVQLMKLLNHPHIIKLYQVMETKDMLY
gi|9978891|            TQVAIKIIDKTRLDSSNLEKIYREVQLMKLLNHPHIIKLYQVMETKDMLY
gi|11067425|           TQVAIKIIDKTRLDSSNLEKIYREVQLMKLLNHPNIIKLYQVMETKDMLY
gi|12643489|           TQVAIKIIDKTRLDSSNLEKIYREVQLMKLLNHPNIIKLYQVMETKDMLY
gi|6754746|            TQVAIKIIDKTRLDSSNLEKIYREVQLMKLLNHPHIIKLYQVMETKDMLY
gi|6760436|            TQVAIKIIDKTRLDPSNLEKIYREVQIMKLLNHPHIIKLYQVMETKDMLY 110       120       130       140       150
                       ....|....|....|....|....|....|....|....|....|....|
NOV14 95073892_dal     IVTEFAKNGEMFDYLTSNGHLSENEARKKFWQILSAVEYCHDHHIVHRDL
gi|9978891|            IVTEFAKNGEMFDYLTSNGHLSENEARKKFWQILSAVEYCHDHHIVHRDL
gi|11067425|           IVTEFAKNGEMFDYLTSNGHLSENEARKKFWQILSAVEYCHNHHIVHRDL
gi|12643489|           IVTEFAKNGEMFDYLTSNGHLSENEARKKFWQILSAVEYCHNHHIVHRDL
gi|6754746|            IVTEFAKNGEMFDYLTSNGHLSENEARQKFWQILSAVEYCHNHHIVHRDL
gi|6760436|            IVTEFAKNGEMFDHLTSNGHLSESEARKKFWQILSAVEYCHSHHIVHRDL 160       170       180       190       200
                       ....|....|....|....|....|....|....|....|....|....|
NOV14 95073892_dal     KTENLLLDGNMDIKLA---DFGFGNFYKSGEPLSTWCGSPPYAAPEVFEG
gi|9978891|            KTENLLLDGNMDIKLAGTEDFGFGNFYKSGEPLSTWCGSPPYAAPEVFEG
gi|11067425|           KTENLLLDGNMDIKLA---DFGFGNFYKPGEPLSTWCGSPPYAAPEVFEG
gi|12643489|           KTENLLLDGNMDIKLA---DFGFGNFYKPGEPLSTWCGSPPYAAPEVFEG
gi|6754746|            KTENLLLDSNMDIKLA---DFGFGNFYKGEPLSTCVGSPPYAAPEVFEG
gi|6760436|            KTENLLLDANMDIKLA---DFGFGNFYKSGEPLSTWCGSPPYAAPEVFEG
```

TABLE 14D-continued

ClustalW Analysis of NOV14

```
                          210        220        230        240        250
                     ....|....|....|....|....|....|....|....|....|....|
NOV14 95073892_dal   KEYEGPQLDIWSLGVVLYVLVCGSLPFDGPNLPTLRQRVLEGRFRIPFFN
gi|9978891|          KEYEGPQLDIWSLGVVLYVLVCGSLPFDGPNLPTLRQRVLEGRFRIPFFN
gi|11067425|         KEYEGPQLDIWSLGVVLYVLVCGSLPFDGPNLPTLRQRVLEGRFRIPFFN
gi|12643489|         KEYEGPQLDIWSLGVVLYVLVCGSLPFDGPNLPTLRQRVLEGRFRIPFFN
gi|6754746|          KEYEGPQLDVWSLGVVLYVLVCGSLPFDGPNLPTLRQRVLEGRFRIPFFN
gi|6760436|          KEYEGPHLDIWSLGVVLYVLVCGSLPFDGPNLPTLRQRVLEGRFRIPXFN 260        270        280        290        300
                     ....|....|....|....|....|....|....|....|....|....|
NOV14 95073892_dal   SQDCESLIR-----------------------------------------
gi|9978891|          SQDCESLIRRMLVVDPAKRITIAQIRQHRWMRASPCLPGPACPAFSAHSY
gi|11067425|         SQDCETLIRRMLVVDPAKRITIAQIRQHRWMQADPTLLQQDDPAFSMQGY
gi|12643489|         SQDCETLIRRMLVVDPAKRITIAQIRQHRWMQADPTLLQQDDPAFSMQGY
gi|6754746|          SQDCETLIRRMLVVDPAKRITIAQIRQHRWMQADPTLLQQDDPAFDMQGY
gi|6760436|          SEDCETLIRRMLVVDPTKRITISQIKQHRWMQADPSLRQQQSLSFSMQNY 310        320        330        340        350
                     ....|....|....|....|....|....|....|....|....|....|
NOV14 95073892_dal   --------------------------------------------------
gi|9978891|          TSNLGDYCEQALGIMQTLGVDRQRTVESLQNSSYNHFAAIYYLLLERLKE
gi|11067425|         TSNLGDYNEQVLGIMQALGIDRQRTVESLQNSSYNHFAAIYYLLLERLRE
gi|12643489|         TSNLGDYNEQVLGIMQALGIDRQRTVESLQNSSYNHFAAIYYLLLERLRE
gi|6754746|          TSNLGDYNEQVLGIMQALGIDRQRTIESLQNSSYNHFAAIYYLLLERLRE
gi|6760436|          NSNLGDYNEQVLGIMQTLGIDRQRTVESLQNSSYNHFAAIYYLLLERLKE 360        370        380        390        400
                     ....|....|....|....|....|....|....|....|....|....|
NOV14 95073892_dal   --------------------------------------------------
gi|9978891|          YRNAQ-CAR--PGPARQPRPRSSDLSGLEVPQEGLSTDPFREALLCPQPQ
gi|11067425|         HRSTQPSSRATPAPARQPQLRNSDLSSLEVPQEILPCDPFRPSLLCPQPQ
gi|12643489|         HRSTQPSSRATPAPARQPQLRNSDLSSLEVPQEILPCDPFRPSLLCPQPQ
gi|6754746|          HRSAQPSSRPTPAPTRQPQLRSSDLSSLEVPQEILPCDPFRPSLLCPQPQ
gi|6760436|          YRSSQLSSR--PATGRQQRPRSSETSNAEMPQDSLTSETLRSSLLYQQPQ 410        420        430        440        450
                     ....|....|....|....|....|....|....|....|....|....|
NOV14 95073892_dal   --------------------------------------------------
gi|9978891|          TLVQSVLQAEMDCKLQSSLQWPLFFPVDASCSGVFRPRPVSPSSLLDTAI
gi|11067425|         ALAQSVLQAEIDCDLHSSLQ-PLFFPLDTNCSGVFRHRSISPSSLLDTAI
gi|12643489|         ALAQSVLQAEIDCDLHSSLQ-PLFFPLDTNCSGVFRHRSISPSSLLDTAI
gi|6754746|          ALAQSVLQAEIDCDLHSSLQ-PLLFPLDTNCSGVFRHRSISPSSLLDTAI
gi|6760436|          SLIQPSLQAEMDCDMNNPLQ-PVFFPVDPNFNGLFRNRSISPSSLLETTI 460        470        480        490        500
                     ....|....|....|....|....|....|....|....|....|....|
NOV14 95073892_dal   --------------------------------------------------
gi|9978891|          SEEARQGPGLEEEQDTQES---LPSSTGRRHTLAEVSTRLSPITAPCKFV
gi|11067425|         SEEARQGPSLEEEQEVQEP---LPGSTGRKHTLAEVSTHFSPLNPPCIKV
gi|12643489|         SEEARQGPSLEEEQEVQEP---LPGSTGRRHTLAEVSTHFSPLNPPCIKV
gi|6754746|          SEEARQGPSLEEEQEVQEP---LPGSTGRRHTLAEVSTHFSPLNPPCIKV
gi|6760436|          SEEVRQEKELEDEIKAYDHPIRRPSNTSRRHTLAEVTTHFYQHAPPCIVI 510        520        530        540        550
                     ....|....|....|....|....|....|....|....|....|....|
NOV14 95073892_dal   --------------------------------------------------
gi|9978891|          SPSTTASPAEGTSSDSCLTFSASKSPAGDSGTPATQGLLGACSPVRLASP
gi|11067425|         SSSAAVSPSEGTSSDSCLPFSASEGPAGDGGGLATPGLLGTSSPVRLASP
gi|12643489|         SSSAAVSPSEGTSSDSCLPFSASEGPAGDGGGLATPGLLGTSSPVRLASP
gi|6754746|          SSSATASPSEGTSSDSCLPFSASEGPAGDGSGLATPGLLGTSSPVRLASP
gi|6760436|          SSS--ASPTEGTSSDSCITSSSNDSSVALSSCLAGQVMTGSPATARMTSA 560        570        580        590        600
                     ....|....|....|....|....|....|....|....|....|....|
NOV14 95073892_dal   --------------------------------------------------
gi|9978891|          FLGSQSATPVLCACGGLGGAVLLPVSFQEGRRASDTSLTQGLKAFRQQLR
gi|11067425|         FLGSQSATPVLCSCAGLCATVLPPVSFQEGRRASDTSLTQGLKAFRQQLR
gi|12643489|         FLGSQSATPVLCSCAGLCATVLPPVSFQEGRRASDTSLTQGLKAFRQQLR
gi|6754746|          FLGSQSATPVLCTCAGLGTAVLPPVSFQEGRRASDTSLTQGLKAFRQQLR
gi|6760436|          FLASQSDAPVLQVQGCMCGASLLPVSFQETRRASDTSLTQGLKAFRQQLR
```

TABLE 14D-continued

ClustalW Analysis of NOV14

```
                        610        620        630        640        650
                   ....|....|....|....|....|....|....|....|....|....|
NOV14 95073892_dal ---------------------------------------------------
gi|9978891|        KTTRTKGFLGLNKIKGLARQVCQAPASEASRGGLSPFHAPAQSPGLHGGA
gi|11067425|       KNARTKGFLGLNKIKGLARQVCQS-SIRGSRGGMSTFHTPAPSSGLQGCT
gi|12643489|       KNARTKGFLGLNKIKGLARQVCQS-SIRGSRGGMSTFHTPAPSSGLQGCT
gi|6754746|        KNARTKGFLGLNKIKGLARQVCQS-SVRTPRGGMSTFHTPAPSSGLQGCT
gi|6760436|        KNARAKGFLGLNKIKGFARQVCQSSSSRAARSAMSPFQHAQENICIYSSS 660        670        680        690        700
                   ....|....|....|....|....|....|....|....|....|....|
NOV14 95073892_dal ---------------------------------------------------
gi|9978891|        AGSREGWSLLEEVIEQQRLLQLQHHP---AAAPGCSQAPQPAPAPRVIAP
gi|11067425|       ASSREGRSLLEEVLHQQRLLQLQHHS---AVSSDYQQAPQLSPVPYVLTP
gi|12643489|       ASSREGRSLLEEVLHQQRLLQLQHHS---AVSSDYQQAPQLSPVPYVLTP
gi|6754746|        TSNREGRSLLEEVLHQQRLLQLQHHSSTAAASSGCQQGPQLSPVPYVLAP
gi|6760436|        GSSREGRNLLEEVLQQQRMLQLQHHQ---LLQPACPQTSQTSATN-GLPP 710        720        730        740        750
                   ....|....|....|....|....|....|....|....|....|....|
NOV14 95073892_dal ---------------------------------------------------
gi|9978891|        CDGPGAAPLPSTLLTSGLP--------------LLPPPLLQTGASPVASA
gi|11067425|       CDG---------LLVSGIP--------------LLPTPLLQPGMSPVASA
gi|12643489|       CDG---------LLVSGIP--------------LLPTPLLQPGMSPVASA
gi|6754746|        CDG---------LLVSGIP--------------LLPTPLLQPGMSPVASA
gi|6760436|        SDSAGTCKASNSLLLSELQRENSFELAFGGNSQLLQPHFFGVSVSPVSSA 760        770        780        790        800
                   ....|....|....|....|....|....|....|....|....|....|
NOV14 95073892_dal -----------------------LARLAPGCEPLGLLQGDCEMGDIM
gi|9978891|        AQLLDTHLHIGTGPTAL-EAVPPR-LARLAPGCEPLGLLQGDCEMEDIM
gi|11067425|       AQLLDAHLHISAGPVAL-PTGPLPQCLRLSPSCDPAGLPQGDCEMEDLT
gi|12643489|       AQLLDAHLHISAGPVAL-PTGPLPQCLRLSPSCDPAGLPQGDCEMEDLT
gi|6754746|        AHLLDTHLHISAGPVAL-PTGPLPQCLRLSPSCDPAGLPQGDCEMEDLT
gi|6760436|        AHLLDTHLNISSNVSPVGTIFSQQQSFSAQSPSYDAVTLQHGDCEMEDLT 810
                   ....|....|.
NOV14 95073892_dal PCSLGTFVLVQ
gi|9978891|        PCSLGTFVLVQ
gi|11067425|       SGQRGTFVLVQ
gi|12643489|       SGQRGTFVLVQ
gi|6754746|        SGQRGTFVLVQ
gi|6760436|        SNQLGKFVLVK
```

Other BLAST results include sequences from the Patp database, which is a proprietary database that contains sequences published in patents and patent publications. Patp results include those listed in Table 14E.

The presence of identifiable domains in the protein disclosed herein was determined by searches versus domain databases such as Pfam, PROSITE, ProDom, Blocks or Prints and then identified by the Interpro domain accession

TABLE 14E

Patp BLASTP Analysis for NOV14

| Sequences producing High-scoring Segment Pairs | Protein/Organism | Length (aa) | Identity (%) | Positive (%) | E Value |
|---|---|---|---|---|---|
| patp: AAB85786 | Human kinase PKIN-5 - *Homo sapiens* | 783 | 256/256 (100%) | 256/256 (100%) | 1.8e−155 |
| patp: AAW90878 | Human keratinocyte derived pKe#122 protein #1 - *Homo sapiens* | 790 | 254/256 (99%) | 254/256 (99%) | 4.4e−154 |
| patp: AAU03518 | Human protein kinase #18 - *Homo sapiens* | 786 | 256/259 (98%) | 256/259 (98%) | 4.4e−154 |
| patp: AAW90879 | Human keratinocyte derived pKe#122 protein #2 - *Homo sapiens* | 823 | 254/256 (99%) | 254/256 (99%) | 5.5e−154 |
| patp: AAB65631 | Novel protein kinase, clone no: 158 - *Homo sapiens* | 926 | 194/239 (81%) | 223/239 (93%) | 6.2e−108 | number. The results indicate that this protein contains the following protein domains (as defined by Interpro) at the indicated positions: eukaryotic protein kinase domain (IPR000719) at amino acid positions 27 to 256. This indicates that the sequence of the invention has properties similar to those of other proteins known to contain this/these domain(s) and similar to the properties of these domains. Table 14F lists the domain description from DOMAIN analysis results against NOV14.

TABLE 14F

Domain Analysis of NOV14

| Pfam analysis PSSMs producing significant alignments: | | Score (bits) | E value |
|---|---|---|---|
| gnl\|Smart\|smart00220 | S_TKc, Serine/Threonine protein kinases, catalytic domain; Pho . . . | 253 | 8e-69 |
| gnl\|Pfam\|pfam00069 | pkinase, Protein kinase domain | 236 | 2e-63 |
| gnl\|Smart\|smart00219 | TyrKc, Tyrosine kinase, catalytic domain; Phosphotransferases . . . | 140 | 1e-34 |
| gnl\|Smart\|smart00219 | TyrKc, Tyrosine kinase, catalytic domain; Phosphotransferases . . . | 140 | 1e-34 | gnl|Smart|smart00220, S_TKc, Serine/Threonine protein kinases, catalytic domain;
Phosphotransferases. Serine or threonine-specific kinase subfamily.
CD-Length = 256 residues, 91.4% aligned
Score = 253 bits (647), Expect = 8e-69

```
NOV14:   27 YDIERTLGKGNFAVVKLARHRVTKTQVAIKIIDKTRLDSSNLEKIYREVQLMKLLNHPHI  86   (SEQ ID NO:265)
             |++   ||||  |  ||| + |  ||||+|  +|      |+| ||++++| |+||+|
Sbjct:    1 YELLEVLGKGAFGKVYLARDKKTGKLVAIKVIKKEKLKKKRERILREIKILKKLDHPNI  60   (SEQ ID NO:266)

NOV14:   87 IKLYQVDMEKDMLYIVTEFAKNGEMFDYLTSNGHLSENEARKKFWQILSAVEYCHDHEIV 146
             +|||  |   | ||+| |+ + |++|| |   ||||+|||    ||||+|| |   |+
Sbjct:   61 VKLYDVFEDDGICLYLVMEYCEGGDLFDLLKKRGRLSEDEARFYARQILSALEYLHSQGII 120

NOV14:  147 HRDLKTENLLLDGNMDIKLADFGFGNFYKSGEP-LSTWCGSPPYAAPEVFEGKEYEGPQL 205
             |||||  ||+|||  + +||||||    ||    |+|+ |+|  |||| ||| |    +
Sbjct:  121 HRDLKPENILLDSDGHVKLADFGLAKQLDSGGTLLTTFVGTPEYMAPEVLLGKGY-GKAV 179

NOV14:  206 DIWSLGVVLYVLVCGSLPFDGP-NLPTLRQRVLEGRFRIPFFM 247
             ||||||+||  |+  ||   |  |      |  | +++ +    |
Sbjct:  180 DIWSLGVILYELLTGKPPFPGDDQLLALFKKIGKPPPPFPPPE 222

NOV14:  248 ---SQDCESLIR 256
                | + + ||+
Sbjct:  223 WKISPEAKDLIK 234
``` gnl|Pfam|pfam00069, pkinase, Protein kinase domain.
CD-Length = 256 residues, 91.4% aligned
Score = 236 bits (601), Expect = 2e-63

```
NOV14:   27 YDIERTLGKGNFAVVKLARHRVTKTQVAIKIIDKTRLDSSNLEKIYREVQLMKLLNHPHI  86   (SEQ ID NO:267)
             |++   ||  |     +|+ |   ||||+ | |   ++    ||+++| |+||+|
Sbjct:    1 YELGEKLGSGAFGKVYKGKHKDTGEIVAIKILKK-RSLSEKKKRFLREIQILRRLSHPNI  59   (SEQ ID NO:268)

NOV14:   87 IKLYQVMETKDMLYIVTEFAKNGEMFDYLTSNGE-LSENEARKKFWQILSAVEYCHDHHI 145
             ++|    |   ||+| |+ + |++||||  ||   |||+|||| ||| +||  +|||   |
Sbjct:   60 VRLLGVFEEDDHLYLVMEYMEGGDLFDYLRRNGLLLSEKEAKKIALQILRGLEYLHSRGI 119

NOV14:  146 VHRDLKTENLLLDGNNDIKLADFCFGNFYKS--GEPLSTWCGSPPYAAPEVFEGKEYEGP 203
             ||||||  ||+|||  |  +|+|||    +|    | |+ |+| |  |||| ||| |||+ |
Sbjct:  120 VHRDLKPENILLDENGTVKIADFGLARKLESSSYEKLTTFVGTPEYMAPEVLEGRGY-SS 178

NOV14:  204 QLDIWSLGVVLYVLVCGSLPFDGPNLPTLRQR-VLEGRFRIPFF 246
             ++|+||||+||  |+  ||   |   |||+|  + |    | |+|
Sbjct:  179 KVDVWSLGVILYELLTGKLPFPGIDPLEELFRIKERPRLRLPLP 222

NOV14:  247 --MSQDCESLIR 256
              |++ + ||+
Sbjct:  223 PNCSEELKDLIK 234
``` gnl|Smart|smart00219, TyrKc, Tyrosine kinase, catalytic domain; Phosphotransferases.
Tyrosine-specific kinase subfamily.
CD-Length = 258 residues, 91.5% aligned
Score = 140 bits (353), Expect = 1e-34

```
NOV14:   29 IERTLGKGNFAVVKLARHR---VTKTQVAIKIIDKTRLDSSNLEKIYREVQLMKLLNHPH  85   (SEQ ID NO:269)
             + + ||+|  |   |       + +||+|+ + |         +|+ || +||+ |+|+
Sbjct:    3 LGKKLGEGAFGEVYKGTLKGKGGVEVEVAVKTL-KEDASEQQIEEFLREARLMRKLDHPN  61   (SEQ ID NO:270)
```

TABLE 14F-continued

Domain Analysis of NOV14

```
NOV14:   86 IIKLYQVMETKDMLYIVTEFAKNGEMFDYLTSNGH--LSENEARKKFWQILSAVEYCEDH 143
            |+||   |   ++ |  || |+ + |++ |||  |    || ++     ||   +||
Sbjct:   62 IVKLLGVCTEEEPLMIVMEYMEGGDLLDYLRKNRPKELSLSDLLSFALQIARGMEYLESK 121

NOV14:  144 HIVHRDLKTENLLLDGNNDIKLADFGFGNFYKSGEPLSTWCGSPP----YAAPEVFEGKE 199
            +  |||||    |  |+  |  +|+||||         +      ||    + |||  + +
Sbjct:  122 NFVHRDLAARNCLVGENKTVKIADFGLARDLYDDDYYRK-KKSPRLPIRWMAPESLKDGK 180

NOV14:  200 YEGPQLDIWSLGVVLY-VLVCGSLPFDGPNLPTLRQRVLEG-RFRIP              244
            +    + |+||  ||+|+ +     |  |+ |  +   + + +|  |     |
Sbjct:  181 F-TSKSDVWSFGVLLWEIFTLGESPYPGMSNEEVLEYLKKGYRLPQP              226

NOV14:  245 FFMSQDCESLIR                                                 256
            +     |+
Sbjct:  227 PNCPDEIYDLML                                                 238
```

The disclosed NOV14 nucleic acid encoding a Protein kinase SNF1LK-like protein includes the nucleic acid whose sequence is provided in Table 14A, or a fragment thereof. The invention also includes a mutant or variant nucleic acid any of whose bases may be changed from the corresponding base shown in Table 14A while still encoding a protein that maintains its Protein kinase SNF1LK-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 5% of the bases may be so changed.

The disclosed NOV14 protein of the invention includes the Protein kinase SNF1LK-like protein whose sequence is provided in Table 14B. The invention also includes a mutant or variant protein any of whose residues may be changed from the corresponding residue shown in Table 14B while still encoding a protein that maintains its Protein kinase SNF1LK-like activities and physiological functions, or a functional fragment thereof. In the mutant or variant protein, up to about 2% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle. Additional SNP variants of NOV14 are disclosed in Examples.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV14 protein has multiple hydrophilic regions, each of which can be used as an immunogen. In one embodiment, a contemplated NOV14 epitope is from about amino acids 1 to 30. In another embodiment, a contemplated NOV14 epitope is from about amino acids 35 to 45. In other specific embodiments, contemplated NOV14 epitopes are from about amino acids 50 to 84, from about amino acids 87 to 92, from about amino acids 98 to 106, from about amino acids 109 to 160, from about amino acids 165 to 206, from about amino acids 226 to 248, and from about amino acids 284 to 291. These novel proteins can be used in assay systems for functional analysis of various human disorders, which will help in understanding of pathology of the disease and development of new drug targets for various disorders.

The protein kinase SNF1LK disclosed in this invention is expressed in at least some of the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. This information was derived by determining the tissue sources of the sequences that were included in the invention including but not limited to SeqCalling sources, Public EST sources, Literature sources, and/or RACE sources.

In addition, the sequence is predicted to be expressed in keratinocytes because of the expression pattern of GENBANK-ID:gb:GENBANK-ID:AX024729|acc:AX024729.1, a closely related homolog in species Homo sapiens. Additional disease indications and tissue expression for NOV14 and NOV14 variants, if available, are presented in the Examples.

The protein similarity information, expression pattern, and map location for the protein kinase SNF1LK-like protein and nucleic acid disclosed herein suggest that this protein kinase SNF1LK may have important structural and/or physiological functions characteristic of the serine/threonine protein kinases family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention may have efficacy for treatment of patients suffering from diseases associated with regulation of adrenocortical functions in response to high plasma salt and ACTH stimulation, disorders associated with dysfunction of the hippocampus and cortex, and other diseases, disorders and conditions of the like.

NOV15

NOV15 includes two novel CD39L2-like proteins. The disclosed sequences have been named NOV15a and NOV15b. Unless specifically addressed as NOV15a or NOV15b, any reference to NOV15 is assumed to encompass all variants.

A disclosed NOV15a nucleic acid of 2693 nucleotides (also referred to as sggc_draft_ba294a4_20000808 or CG50163-01) (SEQ ID NO:35) encoding a novel CD39L2-like protein is shown in Table 15A. An open reading frame was identified beginning with an ATG initiation codon at nucleotides 130–132 and ending with a TAG codon at nucleotides 1531–1533. Putative untranslated regions upstream from the initiation codon and downstream from the termination codon are underlined and the start and stop codons are in bold in Table 15A.

TABLE 15A

NOV15a nucleotide sequence (SEQ ID NO:35)

GTGGGGTCGTATCCCGCGGGTGGAGGCCGGGGTGGCGCCGGCCGGGGCGGGGAGCCCAAAAGACCGGCTGCCGCCTGCT

CCCCGGAAAAGGGCACTCGTCTCCGTGGGTGTGGCGGAGCGCGCGGTGCATGCAGCCGCAGCACGGTCCTTGGCAAACAA

GGATGAGAAAAATATCCAACCACGGGAGCCTGCGGGTGGCGAAGGTGGCATACCCCCTGCGGCTGTGTGTGGGCGTGTTC

ATCTATGTTGCCTACATCAAGTGGCACCGGGCCACCGCCACCCAGGCCTTCTTCAGCATCACCAGGGCAGCCCCGGGGGC

CCGGTCGGGTCAGCAGGCCCACAGCCCCCTGGGGACAGCTGCAGACGGGCACGAGGTCTTCTACCGGATCATGTTTGATG

CAGGAAGCACTGGCACCCGAGTACACGTCTTCCAGTTCACCCGGCCCCCAGAGAAACTCCCACGTTAACCCACGAAACC

TTCAAAGCACTGAAGCCAGGTCTTTCTGCCTATGCTGATGATGTTGAAAAGAGCGCTCACGGAATCCGGGAACTACTGGA

TGTTGCTAAACAGGACATTCCGTTCGACTTCTGGAAGGCCACCCCTCTGGTCCTCAAGGCCACAGCTGGCTTACGCCTGT

TACCTGGAGAAAAGGCCCAGAAGTTACTGCAGAAGGTGAAAGAAGTATTTAAAGCATCGCCTTTCCTTGTAGGGGATGAC

TGTGTTTCCATCATCAACGCAACAGATGAAGGCGTTTCGGCGTGGATCACCATCAACTTCCTGACACGCAGCTTGAAAAC

TCCAGGAGGGAGCAGCGTGGGCATGCTGGACTTGGGCGGAGGATCCACTCAGATCGCCTTCCTGCCACGCGTGGAGGGCA

CCCTGCAGGCCTCCCCACCCGGCTACCTGACGGCACTGCGGATGTTTAACAGGACCTACAAGCTCTATTCCTACAGCTAC

CTCGGGCTCGGGCTGATGTCGGCACGCCTGGCGATCCTGGGCGGCGTGGAGGGGCAGCCTGCTAAGGATGGAAAGGAGTT

GGTCAGCCCTTGCTTGTCTCCCAGTTTCAAAGGAGAGTGGGAACACGCAGAAGTCACGTACAGGGTTTCAGGGCAGAAAG

CAGCGGCAAGCCTGCACGAGCTGTGTGCTGCCAGAGTGTCAGAGGTCCTTCAAAACAGAGTGCACAGGACGGAGGAAGTG

AAGCATGTGGACTTCTATGCTTTCTCCTACTATTACGACCTTGCAGCTGGTGTGGGCCTCATAGATGCGGAGAAGGGAGG

CAGCCTGGTGGTGGGGGACTTCGAGATCGCACCCAAGTACGTGTGTCGGACCCTGGAGACACAGCCGCAGAGCAGCCCCT

TCTCATGCATGGACCTCACCTACGTCAGCCTGCTACTCCAGGAGTTCGGCTTTCCCAGGAGCAAAGTGCTGAAGCTCACT

CGGAAAATTGACAATGTTGAGACCAGCTGGGCTCTGGGGGCCATTTTTCATTACATCGACTCCCTGAACAGACAGAAGAG

TCCAGCCTCATAGTGGCCGAGCCATCCCTGTCCCCGTCAGCAGTGTCTGTGTGTCTGCATAAACCCTCCTGTCCTGGACG

TGACTTCATCCTGAGGAGCCACAGCACAGGCCGTGCTGGCACTTTCTGCACACTGGCTCTGGGACTTGCAGAAGGCCTGG

TGCTGCCCTGGCATCAGCCTCTTCCAGTCACATCTCGCCAGAGGGCTGTCTGGACCTGGGCCCTGCTCAATGCCACCTGT

CTGCCTGGGCTCCAAGTGGGCAGGACCAGGACAGAACCACAGGCACACACTGAGGGGGCAGTGTGGCTCCCTGCCTGTCC

CATCCCCATGCCCCGTCCGCGGGGCTGTGGCTGCTGCTGTGCATGTCCCTGCGATGGGAGTCTTGTCTCCCAGCCTGTCA

GTTTCCTCCCCAGGGCAGAGCTCCCCTTCCTGCAAGAGTCTGCGAGGCGGTGCAGGCTGTCCTGGCTGCTCTGGGGAAGC

TABLE 15A-continued

NOV15a nucleotide sequence (SEQ ID NO:35)

CGAGGGACAGCCATAACACCCCCGGGACAGTAGGTCTGGGCGGCACCACTGGGAACTCTGGACTTGAGTCTGTTTGCTCT

TCCTTGGGTATGAATGTGTGAGTTCACCCAGAGGCCTGCTCTCCTCACACATTGTGTGGTTTGGGGTTAATGATGGAGGG

AGACACCTCTTCATAGACGGCAGGTGCCCACCTTTCAGGGAGTCTCCCAGCATGGGCGGATGCCGGGCATGAGCTGCTGT

AAACTATTTGTGGCTGTGCTGCTTGAGTGACGTCTCTGTCGTGTGGGTGCCAAGTGCTTGTGTAGAAACTGTGTTCTGAG

CCCCCTTTTCTGGACACCAACTGTGTCCTGTGAATGTATCGCTACTGTGAGCTGTTCCCGCCTAGCCAGGGCCATGTCTT

AGGTGCAGCTGTGCCACGGGTCAGCTGAGCCACAGTCCCAGAACCAAGCTCTCGGTGTCTCGGGCCACCATCCGCCCACC

TCCGGCTGACCCCACCTCCTCCATGGACAGTGTGAGCCCCGGGCCGTGCATCCTGCTCAGTGTGGCGTCAGTGTCGGGGC

TGAGCCCCTTGAGCTGCTTCAGTGAATGTACAGTGCCCGGCACGAGCTGAACCTCATGTGTTCCACTCCCAATAAAAGGT

TGACAGGGGCTTCTCCTTCAAAAAAAAAAAAAAAAAAAAAAAAAAAAAAAAAAA

---

The CD39L2-like NOV15 disclosed in this invention maps to chromosome 20.

A disclosed NOV15a polypeptide (SEQ ID NO:36) encoded by SEQ ID NO:35 has 467 amino acid residues and is presented in Table 15B using the one-letter code. NOV15a polypeptides are likely Type II (Ncyt Cexo) membrane proteins. Analysis of NOV15a with INTEGRAL software predicts a likelihood of –2.60 of having a transmembrane domain at residues 27–43 (23–43). The SignalP, Psort and/or Hydropathy results predict that NOV15a is likely to be localized extracellularly or at the plasma membrane with a certainty of 0.7900. This prediction is confirmed by data from the literature demonstrating that other family members may be localized extracellularly or at the plasma membrane (Biochemistry 2000 Oct. 24; 39(42):12916–23). In an alternative embodiment, NOV15a is likely to be localized to the microbody (peroxisome) with a certainty of 0.7480, or to the Golgi body with a certainty of 0.3000, or to the endoplasmic reticulum membrane with a certainty of 0.2000.

In a search of sequence databases, it was found, for example, that the nucleic acid sequence of NOV15a has 2564 of 2567 bases (99%) identical to a gb:GENBANK-ID:AF039916|acc:AF039916.1 Mrna from *Homo sapiens* (CD39L2) Mrna, complete cds). The full amino acid sequence of the protein of NOV15a was found to have 465 of 466 amino acid residues (99%) identical to, and 466 of 466 amino acid residues (100%) similar to, the 484 amino acid residue ptnr:SPTREMBL-ACC:O75354 protein from *Homo sapiens* (CD39L2). The sequence of this invention has a different start when compared to ptnr:SPTREMBL-ACC:O75354 protein from *Homo sapiens* (CD39L2), as well as another amino acid change.

In an alternative embodiment, a NOV15 variant is a NOV15b nucleic acid of 2648 nucleotides (also referred to as CG50163-02) (SEQ ID NO:37) encoding a novel CD39L2-like protein shown in Table 15C. An open reading frame was identified beginning with an ATG initiation codon at nucleotides 148–150 and ending with a TAG codon at

TABLE 15B

NOV15a protein sequence (SEQ ID NO:36)

MQPQHGPWQTRMRKISNHGSLRVAKVAYPLGLCVGVFIYVAYIKWHRATATQAFFSITRAAPGARWGQQA

HSPLGTAADGHEVFYGIMFDAGSTGTRVHVFQFTRPPRETPTLTHETFKALKPGLSAYADDVEKSAQGIR

ELLDVAKQDIPFDFWKATPLVLKATAGLRLLPGEKAQKLLQKVKEVFKASPFLVGDDCVSIMNGTDEGVS

AWITINFLTGSLKTPGGSSVGMLDLGGGSTQIAFLPRVEGTLQASPPGYLTALRNFNRTYKLYSYSYLGL

GLMSARLAILGGVEGQPAKDGKELVSPCLSPSFKGEWEHAEVTYRVSGQKAAASLHELCAARVSEVLQNR

VHRTEEVKHVDFYAFSYYYDLAAGVGLIDAEKGGSLVVGDFEIAAKYVCRTLETQPQSSPFSCMDLTYVS

LLLQEFGFPRSKVLKLTRKIDNVETSWALGAIFHYIDSLNRQKSPAS nucleotides 1486–1488. Putative untranslated regions upstream from the initiation codon and downstream from the termination codon are underlined and the start and stop codons are in bold in Table 15C.

TABLE 15C

NOV15b nucleotide sequence (SEQ ID NO:37)

GTGGGGTCGTATCCCGCGGGTGGAGGCCGGGGTGGCGCCGGCCGGGGCGGGGAGCCCAA

AAGACCGGCTGCCGCCTGCTCCCCGGAAAAGGGCACTCGTCTCCGTGGGTGTGGCGGAGC

GCGCGGTGCATGGAATGGGCTATGTGAATGAAAAAAGGTATCCGTTATGAAACTTCCAGA

AAAACGAGCTACATTTTTCAGCAGCCGCAGCACGGTCCTTGGCAAACAAGGATGAGAAAA

ATATCCAACCACGGGAGCCTGCGGGTGGCGGTGGCCCGGTGGGGTCAGCAGGCCCACAGC

CCCCTGGGGACAGCTGCAGACGGGCACGAGGTCTTCTACGGGATCATGTTTGATGCAGGA

AGCACTGGCACCCGAGTACACGTCTTCCAGTTCACCCGGCCCCCCAGAGAAACTCCCACG

TTAACCCACGAAACCTTCAAAGCACTGAAGCCAGGTCTTTCTCCCTATGCTGATGATGTT

GAAAAGAGCGCTCAGQGAATCCGGGAACTACTGGATGTTGCTAAACAGGACATTCCGTTC

GACTTCTGGAAGGCCACCCCTCTGGTCCTCAAGGCCACAGCTGGCTTACGCCTGTTACCT

GGAGAAAAGGCCCAGAAGTTACTGCAGAAGGTGAAAGGAGTATTTAAAGCATCGCCTTTC

CTTGTAGGGGATGACTGTGTTTCCATCATGAACGGAACAGATGAAGGCGTTTCGGCGTGG

ATCACCATCAACTTCCTGACAGGCAGCTTGAAAACTCCAGGAGGGAGCAGCGTGGGCATG

CTGGACTTGGGCGGAGGATCCACTCAGATCGCCTTCCTGCCACGCGTGGAGGGCACCCTG

CAGGCCTCCCCACCCGGCTACCTGACGGCACTGCGGATGTTTAACAGGACCTACAAGCTC

TATTCCTACAGCTACCTCGCGCTCGGGCTGATGTCGGCACGCCTGGCGATCCTGGGCGGC

GTGGAGGGGCAGCCTGCTAAGGATGGAAAGGAGTTGGTCAGCCCTTGCTTGTCTCCCAGT

TTCAAAGGAGAGTGGGAACACGCAGAAGTCACGTACAGGGTTTCAGGGCAGAAAGCAGCG

GCAAGCCTGCACGAGCTGTGTGCTGCCAGAGTGTCAGAGGTCCTTCAAAACAGAGTGCAC

AGGACGGAGGAAGTGAAGCATGTGGACTTCTATGCTTTCTCCTACTATTACGACCTTGCA

GCTGGTGTGGGCCTCATAGATGCCGAGAAGGGAGGCAGCCTGGTGGTGGGGGACTTCGAG

ATCGCAGCCAAGTACGTGTGTCGGACCCTGGAGACACAGCCGCAGAGCAGCCCCTTCTCA

TGCATGGACCTCACCTACGTCAGCCTGCTACTCCAGGAGTTCCGCTTTCCCAGGAGCAAA

GTGCTGAAGCTCACTCGGAAAATTGACAATGTTGAGACCAGCTGGGCTCTGGGGGCCATT

TTTCATTACATCGACTCCCTGAACAGACAGAAGAGTCCAGCCTCATAGTGGCCGAGCCAT

CCCTGTCCCCGTCAGCAGTGTCTGTGTCTCTGCATAAACCCTCCTGTCCTGGACGTGACT

TCATCCTGAGGAGCCACAGCACAGGCCGTGCTGGCACTTTCTGCACACTGGCTCTGCGAC

TTGCAGAAGGCCTGGTGCTGCCCTGGCATCAGCCTCTTCCAGTCACATCTGGCCAGAGGG

CTGTCTGGACCTGGGCCCTGCTCAATGCCACCTGTCTGCCTGGGCTCCAAGTGGGCAGGA

CCAGGACAGAACCACAGGCACACACTGAGGGGGCAGTGTGGCTCCCTGCCTGTCCCATCC

CCATGCCCCGTCCGCGGGGCTGTGGCTGCTGCTGTGCATGTCCCTGCGATGGGAGTCTTG

TCTCCCAGCCTGTCAGTTTCCTCCCCAGGGCAGAGCTCCCCTTCCTGCAAGAGTCTGGGA

GGCGGTGCAGGCTGTCCTGGCTGCTCTGGGGAAGCCGAGGGACAGCCATAACACCCCCGG

GACAGTAGGTCTGGGCGGCACCACTGGGAACTCTGGACTTGAGTGTGTTTGCTCTTCCTT

GGGTATCAATGTGTGAGTTCACCCAGAGGCCTGCTCTCCTCACACATTGTGTGGTTTGGG

GTTAATGATGGAGGGAGACACCTCTTCATAGACGGCAGGTGCCCACCTTTCAGGGAGTCT

CCCAGCATGGGCGGATGCCGGGCATGAGCTGCTGTAAACTATTTGTGGCTGTGCTGCTTG

TABLE 15C-continued

NOV15b nucleotide sequence (SEQ ID NO:37)

AGTGACGTCTCTGTCGTGTGGGTGCCAAGTGCTTGTGTAGAAACTGTGTTCTGAGCCCCC

TTTTCTGGACACCAACTGTGTCCTGTGAATGTATCGCTACTGTGAGCTGTTCCCGCCTAG

CCAGGGCCATGTCTTAGGTGCAGCTGTGCCACGGGTCAGCTGAGCCACAGTCCCAGAACC

AAGCTCTCCGTGTCTCGGGCCACCATCCGCCCACCTCGGGCTGACCCCACCTCCTCCATG

GACAGTGTGAGCCCCGGGCCGTGCATCCTGCTCAGTGTGGCGTCAGTGTCGGGGCTGAGC

CCCTTGAGCTGCTTCAGTGAATGTACAGTGCCCGGCACGAGCTGAACCTCATGTGTTCCA

CTCCCAATAAAAGGTTGACAGGGGCTTCTCCTTCAAAAAAAAAAAAAAAAAAAAAAAAAA

AAAAAAAA

The encoded protein of NOV15b (SEQ ID NO:38) having 446 amino acid residues is presented in Table 15D using the one-letter code. The SignalP, Psort and/or Hydropathy results predict that NOV15b is likely to be localized to the microbody (peroxisome) with a certainty of 0.7252. In an alternative embodiment, NOV15b is likely to be localized to the lysosome lumen with a certainty of 0.1793, or to the mitochondrial matrix space with a certainty of 0.1000, or to the endoplasmic reticulum membrane with a certainty of 0.0000 (not clear).

sequence of the protein of NOV15b was found to have 403 of 404 amino acid residues (99%) identical to, and 403 of 404 amino acid residues (99%) similar to, the 484 amino acid residue ptnr:SPTREMBL-ACC:Q9UJD1 protein from *Homo sapiens* (DJ738P15.2 (CD39-LIKE 2, A NUCLEOSIDE PHOSPHATASE)). In addition to individual amino acid differences, the sequence of this invention lacks 38 internal amino acids when compared to ptnr:SPTREMBL-

TABLE 15D

NOV15b protein sequence (SEQ ID NO:38)

MKKGIRYETSRKTSYIFQQPQHGPWQTRNRKISNHGSLRVAVARWGQQAHSPLGTAADGH

EVFYGIMFDAGSTGTRVHVFQFTRPPRETPTLTHETFKALKPGLSAYADDVEKSAQGIRE

LLDVAKQDIPFDFWKATPLVLKATAGLRLLPGEKAQKLLQKVKGVFKASPFLVGDDCVSI

MNGTDEGVSAWITINFLTGSLKTPGGSSVGMLDLGGGSTQIAFLPRVEGTLQASPPGYLT

ALRMFNRTYKLYSYSYLGLGLMSARLAILGGVEGQPAKDGKELVSPCLSPSFKGEWEHAE

VTYRVSGQKAAASLUELCAARVSEVLQNRVHRTEEVKHVDFYAFSYYYDLAAGVGLIDAE

KGGSLVVGDFEIAAKYVCRTLETQPQSSPFSCMDLTYVSLLLQEFGFPRSKVLKLTRKID

NVETSWALGAIFHYIDSLNRQKSPAS

In a search of sequence databases, it was found, for example, that the nucleic acid sequence of NOV15b has 2377 of 2380 bases (99%) identical to a gb:GENBANK-ID:AF039916|acc:AF039916.1 mRNA from *Homo sapiens* (CD39L2) mRNA, complete cds). The full amino acid sequence of the protein of NOV15b was found to have ACC:Q9UJD1 protein from *Homo sapiens* (DJ738P15.2 (CD39-LIKE 2, A NUCLEOSIDE PHOSPHATASE)).

In a search of public sequence databases, NOV15 was found to have homology to the amino acid sequences shown in the BLASTP data listed in Table 15E.

TABLE 15E

BLASTP results for NOV15

| Gene Index/ Identifier | Protein/Organism | Length (aa) | Identity (%) | Positives (%) | Expect |
|---|---|---|---|---|---|
| gi\|4557423\| ref\|NP_001238.1\| (NM_001247) | ectonucleoside triphosphate diphosphohydrolase 6 (putative function); CD39-like 2 [*Homo sapiens*] | 484 | 465/466 (99%) | 466/466 (99%) | 0.0 |

TABLE 15E-continued

BLASTP results for NOV15

| Gene Index/ Identifier | Protein/Organism | Length (aa) | Identity (%) | Positives (%) | Expect |
|---|---|---|---|---|---|
| gi\|11420372\| ref\|XP_009435.1\| (XM_009435) | ectonucleoside triphosphate diphosphohydrolase 6 (putative function) [*Homo sapiens*] | 484 | 465/466 (99%) | 466/466 (99%) | 0.0 |
| gi\|16758256\| ref\|NP_445950.1\| (NM_053498) | ectonucleoside triphosphate diphosphohydrolase 6 [*Rattus norvegicus*] | 455 | 395/455 (86%) | 421/455 (91%) | 0.0 |
| gi\|5139519\|emb\| CAB45533.1\| (AJ238636) | nucleoside diphosphatase (ER-UDPase) [*Mus musculus*] | 427 | 203/378 (53%) | 259/378 (67%) | e-107 |
| gi\|4557427\| ref\|NP_001240.1\| (NM_001249) | ectonucleoside triphosphate diphosphohydrolase 5; CD39-like 4 [*Homo sapiens*] | 428 | 201/377 (53%) | 256/377 (67%) | e-107 |

A multiple sequence alignment is shown in Table 15F, with the proteins of the invention being shown on lines one and two in a ClustalW analysis comparing the protein of the invention with related protein sequences shown in Table 15E.

TABLE 15F

ClustalW Analysis of NOV15

1) NOV15a ba294a4_20000808 (SEQ ID NO:36)
2) NOV15b CG50163-02 (SEQ ID NO:38)
3) gi|4557423| (SEQ ID NO:123)
4) gi|11420372| (SEQ ID NO:124)
5) gi|16758256| (SEQ ID NO:125)
6) gi|5139519| (SEQ ID NO:126)
7) gi|4557427| (SQE ID NO:127)

```
                                    10         20         30         40         50
                                    ....|....|....|....|....|....|....|....|....|....|
NOV15a ba294a4_20000808  ----------------MQPQHGPWQTRMRKISNHGSLRVAKVAYPLGLC
NOV15b CG50163-02        MKKGIRYETSRKTSYIFQQPQHGPWQTRMRKISNHGSLRVA---------
gi|4557423|              MKKGIRYETSRKTSYIFQQPQHGPWQTRMRKISNHGSLRVAKVAYPLGLC
gi|11420372|             MKKGIRYETSRKTSYIFQQPQHGPWQTRMRKISNHGSLRVAKVAYPLGLC
gi|16758256|             -------------------------MRKIPNHGTLRMTKVAYPLGLC
gi|5139519|              ----------------MATSWG--AVFMLIIACVGSTVFYR--------
gi|4557427|              ----------------MATSWGT-VFFMLVVSCVCSAVSHR--------

60         70         80         90        100
                                    ....|....|....|....|....|....|....|....|....|....|
NOV15a ba294a4_20000808  VGVFIYVAYIKWHRATATQAFFSITRAAPGARWGQQAHSPLGTAADGHEV
NOV15b CG50163-02        ---------------------------VARWGQQAHSPLGTAADGHEV
gi|4557423|              VGVFIYVAYIKWHRATATQAFFSITRAAPGARWGQQAHSPLGTAADGHEV
gi|11420372|             VGVFIYVAYIKWHRATATQAFFSITRAAPGARWGQQAHSPLGTAADGHEV
gi|16758256|             VGLFIYVAYIKWHRASAAQAFFTIAGAASGVRWTQQAFSSPDSATRGHEV
gi|5139519|              -------------------------EQQTWEEGVFLSSMCPINVSAGT
gi|4557427|              -------------------------NQQTWEEGIFLSSMCPINVSAST 110        120        130        140        150
                                    ....|....|....|....|....|....|....|....|....|....|
NOV15a ba294a4_20000808  FYGIMFDAGSTGTRVHVFQFTRP-PRETPTLTHETFKAVKPGLSAYADDV
NOV15b CG50163-02        FYGIMFDAGSTGTRVHVFQFTRP-PRETPTLTHETFKAVKPGLSAYADDV
gi|4557423|              FYGIMFDAGSTGTRVHVFQFTRP-PRETPTLTHETFKAVKPGLSAYADDV
gi|11420372|             FYGIMFDAGSTGTRVHVFQFTRP-PRETPTLTHETFKAVKPGLSAYADDV
gi|16758256|             FYGIMFDAGSTGTRIHVFQFARP-PGETPTLTHETFKAVKPGLSAYADDV
gi|5139519|              FYGIMFDAGSTGTRVHVYTRVQKTAGQLPFLEGEIPDSVKPGLSAEVDQP
gi|4557427|              LYGIMFDAGSTGTRIHVYTRVQKTPGQLPFLEGEIPDSVKPGLSAFVDQP
```

TABLE 15F-continued

ClustalW Analysis of NOV15

```
                                  160        170        180        190        200
                             ....|....|....|....|....|....|....|....|....|....|
NOV15a ba294a4_20000808      EKSAQGIRELLDVAKQDIPEDFWKATPLVLKATAGLRLLPGEKAQKLLQK
NOV15b CG50163-02            EKSAQGIRELLDVAKQDIPEDFWKATPLVLKATAGLRLLPGEKAQKLLQK
gi|4557423|                  EKSAQGIRELLDVAKQDIPEDFWKATPLVLKATAGLRLLPGEKAQKLLQK
gi|11420372|                 EKSAQGIRELLDVAKQDIPEDFWKATPLVLKATAGLRLLPGEKAQKLLQK
gi|16758256|                 EKSAQGICELLNVAKQHIPYDFWKATPLVLKATAGLRLLPGEKAQKLLQK
gi|5139519|                  KQGAETVQELLDVAKDSIPRSHWERTPVVLKATAGLRLLPEQKAQALLLE
gi|4557427|                  KQGAETVQGLLEVAKDSIPRSHWKKTPVVLKATAGLRLLPEHKAKALLFE 210        220        230        240        250
                             ....|....|....|....|....|....|....|....|....|....|
NOV15a ba294a4_20000808      VKEVFKASPFLVGDDCVSIMNGTDEGVSAWITENFLTGSLKTPCGSSVGM
NOV15b CG50163-02            VKGVFKASPFLVGDDCVSIMNGTDEGVSAWITENFLTGSLKTPCGSSVGM
gi|4557423|                  VKEVFKASPFLVGDDCVSIMNGTDEGVSAWITRNFLTGSLKTPCGSSVGM
gi|11420372|                 VKKVFKASPFLVGDDCVSIMNGTDEGVSAWITENFLTGSLKTPCGSSVGM
gi|16758256|                 VKEVFKASPFLVGDDCVSIMNGTDEGVSAWITVNFLTGSLKTPCGSSVGM
gi|5139519|                  VEEIFKNSPFLVPDGSVSIMDGSYEGILAWVTVNFLTGQLHGRGQETVGT
gi|4557427|                  VKEIFRKSPFLVPKGSVSIMEGSDEGILAWVTVNFLTGQLHGHRQETVGT 260        270        280        290        300
                             ....|....|....|....|....|....|....|....|....|....|
NOV15a ba294a4_20000808      LDLGGGSTQIAFLPRVEGTLQASPPGYLTALRMFNRTYKLYSYSYLGLGL
NOV15b CG50163-02            LDLGGGSTQIAFLPRVEGTLQASPPGYLTALRMFNRTYKLYSYSYLGLGL
gi|4557423|                  LDLGGGSTQIAFLPRVEGTLQASPPGYLTALRMFNRTYKLYSYSYLGLGL
gi|11420372|                 LDLGGGSTQIAFLPRVEGTLQASPPGYLTALRMFNRTYKLYSYSYLGLGL
gi|16758256|                 LDLGGGSTQITFLPRVEGTLQASPPRYLTALQMFNRTEKLYSYSYLGLGL
gi|5139519|                  LDLGGASTQITFLPQFEKTLEQTPRGYLTSFEMFNSTEKLYTHSYLGFGL
gi|4557427|                  LDLGGASTQITFLPQFEKTLEQTPRGYLTSFEMFNSTYKLYITHSYLGFGL 310        320        330        340        350
                             ....|....|....|....|....|....|....|....|....|....|
NOV15a ba294a4_20000808      MSARLAILGGVEGQPAKDGKELVSPCLSPSEKGEWEHAEVTYRVSGQKAA
NOV15b CG50163-02            MSARLAILGGVEGQPAKDGKELVSPCLSPSEKGEWEHAEVTYRVSGQKAA
gi|4557423|                  MSARLAILGGVEGQPAKDGKELVSPCLSPSEKGEWEHAEVTYRVSGQKAA
gi|11420372|                 MSARLAILGGVEGQPAKDGKELVSPCLSPSEKGEWEHAEVTYRVSGQKAA
gi|16758256|                 MSARLAILGGVEGKPASDDKELVSPCLSPREKGKWEHAEVTYRISGQKAV
gi|5139519|                  KAARLATLGALEAKGT-DGHTFRSACLPRWLEAEWIFGGVKYQYGGNQEG
gi|4557427|                  KAARLATLGALEAKGT-DGHTFRSACLPRWLEAEWIFGGVKYQYGGNQEG 360        370        380        390        400
                             ....|....|....|....|....|....|....|....|....|....|
NOV15a ba294a4_20000808      ASLHELCAARVSEVLQNRVHRTEEVKHVDFYAFSYYYDLAAGVGLIDAEK
NOV15b CG50163-02            ASLHELCAARVSEVLQNRVHRTEEVKHVDFYAFSYYYDLAAGVGLIDAEK
gi|4557423|                  ASLHELCAARVSEVLQNRVHRTEEVKHVDFYAFSYYYDLAAGVGLIDAEK
gi|11420372|                 ASLHELCAARVSEVLQNRVHRTEEVKHVDFYAFSYYYDLAAGVGLIDAEK
gi|16758256|                 G-LYELCASRVSEVLRNKVHRTEEACHVDFYAFSYYYDLAASFGLIDAEK
gi|5139519|                  EMGFEPCYAEVLRVVQGKIHQPEEVRGSAFYAFSYYYDRAADTHLIDYEK
gi|4557427|                  EVGFEPCYAEVLRVVRGKIHQPEEVRGSFYAFSYYYDRAVDTDMIDYEK 410        420        430        440        450
                             ....|....|....|....|....|....|....|....|....|....|
NOV15a ba294a4_20000808      GGSLVVGDFEIAAKYVCRTLETQPQSSPFSCMDLTYVSLLLQE-FGFPRS
NOV15b CG50163-02            GGSLVVGDFEIAAKYVCRTLETQPQSSPFSCMDLTYVSLLLQE-FGFPRS
gi|4557423|                  GGSLVVGDFEIAAKYVCRTLETQPQSSPFSCMDLTYVSLLLQE-FGFPRS
gi|11420372|                 GGSLVVGDFEIAAKYVCRTLETQPQSSPFSCMDLTYVSLLLQE-FGFPRD
gi|16758256|                 GGSLVVGDFEIAAKYVCRTLETQPPSSPFACMDLTYISLLLHE-FGFPGD
gi|5139519|                  GGVLKVEDFERKAREVCDNLGSFSSGSPFLCMDLTYITALLKDGFGFADG
gi|4557427|                  GGILKVEDFERKAREVCDNLENFTSGSPFLCMDLSYITALLKDGFGFADS 460        470        480
                             ....|....|....|....|....|....|....|....|.
NOV15a ba294a4_20000808      KVLKLTRKIDNVETSWALGAIFHYIDSLNRQKSPAS
NOV15b CG50163-02            KVLKLTRKIDNVETSWALGAIFHYIDSLNRQKSPAS
gi|4557423|                  KVLKLTRKIDNVETSWALGAIFHYIDSLNRQKSPAS
gi|11420372|                 KVLKLTRKIDNVETSWALGAIFHYIDSLNRQKSPAS
gi|16758256|                 KVLKLARKIDNVETSWALGAIFHYIDSLKRQKVPAL
gi|5139519|                  TKLQLTKKVNNEETGWALGATFHLLQSLGITS----
gi|4557427|                  TVLQLTKKVNNEETGWALGATFHLLQSLGISH----
```

Other BLAST results include sequences from the Patp database, which is a proprietary database that contains sequences published in patents and patent publications. Patp results include those listed in Table 15G.

TABLE 15G

Patp BLASTP Analysis for NOV15

| Sequences producing High-scoring Segment Pairs | Protein/Organism | Length (aa) | Identity (%) | Positive (%) | E Value |
|---|---|---|---|---|---|
| patp: AAB72241 | Human CD39 like protein CD39-L2 amino acid sequence - *Homo sapiens* | 484 | 465/466 (99%) | 466/466 (100%) | 1.3e−251 |
| patp: AAM93929 | Human polypeptide, clone no: 4100 - *Homo sapiens* | 456 | 454/456 (99%) | 454/456 (99%) | 4.2e−244 |
| patp: AAB72242 | Mature human CD39 like protein CD39-L2 amino acid sequence - *Homo sapiens* | 471 | 397/404 (98%) | 399/404 (98%) | 2.3e−213 |
| patp: AAY44849 | Human CD39-L4 protein - *Homo sapiens* | 428 | 203/387 (52%) | 260/387 (67%) | 1.6e−100 |
| patp: AAB72238 | Human CD39 like protein CD39-L4 amino acid sequence - *Homo sapiens* | 428 | 203/387 (52%) | 260/387 (67%) | 1.6e−100 |

The presence of identifiable domains in the protein disclosed herein was determined by searches versus domain databases such as Pfam, PROSITE, ProDom, Blocks or Prints and then identified by the Interpro domain accession number. The results for NOV15a indicate that this protein contains the following protein domains (as defined by Interpro) at the indicated positions: domain name GDA1/CD39 (nucleoside phosphatase) family at amino acid positions 76 to 466. This indicates that the sequence of the invention has properties similar to those of other proteins known to contain this/these domain(s) and similar to the properties of these domains. In addition, the results for NOV15b indicate that this protein contains the following protein domains (as defined by Interpro) at the indicated positions: domain name GDA1/CD39 (nucleoside phosphatase) at amino acid positions 55 to 445. This indicates that the sequence of the invention has properties similar to those of other proteins known to contain this/these domain(s) and similar to the properties of these domains. Table 15H lists the domain description from DOMAIN analysis results against NOV15.

TABLE 15H

Domain Analysis of NOV15

| Pfam analysis<br>PSSMs producing significant alignments: | Score (bits) | E value |
|---|---|---|
| gnl\|Pfam\|pfam01150 GDA1_CD39, GDA1/CD39 (nucleoside phosphatase) family | 211 | 7e−56 |

```
gnl|Pfam|pfam01150, GDA1_CD39, GDA1/CD39 (nucleoside phosphatase) family.
CD-Length = 424 residues, 96.7% aligned
Score = 211 bits (537), Expect = 7e-56

NOV15:   82 EVFYGIMFDAGSTGTRVHVFQFTRPPRETPTLTH-----ETFKALKPGLSAYADDVEKSA 136  (SEQ ID NO:271)
              ||++ ||||+|||+||+++     |   |   |||+|||++|   |++|
Sbjct:    7 NVKYGVVIDAGSSGTRLHVYKW---KDEDLDLLQIVPLIEEFKKLEPGLSSFATKPEEAA  63  (SEQ ID NO:272)

*
NOV15:  137 QGIRELLDVAKQDIPFDFWKATPLVLKATAGLRLLPGEKAQKLLQKVKEVFK-ASPFLVG 195
            + +  ||+ |++ ||       ||+ | ||||+|||| + ++|+|+ ++    |  | |
Sbjct:   64 KYLTPLLEFAEEVIPDSQLSETPVFLGATAGMRLLPEDASEKILRALRNGLKSLSTFPVD 123

NOV15:  196 DDCVSIMNGTDEGVSAWITINFLTGSL----KTPGGSSVGMLDLGGGSTQIAFLPRVEGT 251
            |   | ++| +|+  |||+|+|  |      +     |+||++|||| ||||||| |+
Sbjct:  124 DQGVRIIDGAEEGLYGWITVNYLLGRFGKDPEQCRQSTVGVIDLGGASTQIAFEPQEGFV 183

NOV15:  252 LQASPPGYLTALRMFNRTYKLYSYSYLGLGLMSARLAILGGVEGQPAKDGKELV--SPCL 309
            + +       |+     + |         ||    +  |+   +   |+   |+  |||
Sbjct:  184 IASKVEDGNLYLQQERLYGEKYDVYVHSFLGYGANEA-LRKYLAKLISNLSNLILSDPCL 242

NOV15:  310 SPSFKGEWEHAEVTYRVSGQKAAASLHELCAARVSEVLQNRVHRTEE------------- 356
            | |   ++|| + | +    + | + +  +|           |
Sbjct:  243 PPGFNKTVSYSEVEFDVFAIRGTGN-WEQCSNSIRELLNKNAVCPYEQCTFNGVHAPSIG 301

NOV15:  357 VKHVDFYAFSYYYDLAAGVGLIDAEKGGSLVVGDFEIAAKYVCRTLETQPQSS------- 409
              +  |  |+   ||+ + |         ||  |          +|
Sbjct:  302 ALQKNIGASSYFYTTGDFFGLVGEYEVASPE--KLTDKAKEACSKNWEDIKSGYPKTLDK 359
```

TABLE 15H-continued

Domain Analysis of NOV15

```
NOV15:  410  ----PFSCMDLTYV-SLLLQEFGFPR-SKVLKLTRKIDNVETS            446
                 ++|  ||  |+  |||     |        |++++  +||    |
Sbjct:  360  NVSEEYACFDLAYILSLLHDGFSLDPTSELIQSVKKIAGSEAG           402

NOV15:  447  WALGAIFHYIDSLN                                         460
                |  |||+ +  ++|
Sbjct:  403  WTLGAMLYLTNALP                                         416
```

The disclosed NOV15 nucleic acids encoding a CD39L2-like proteins include the nucleic acids whose sequences are provided in Table 15A and Table 15C, or a fragment thereof. The invention also includes a mutant or variant nucleic acid any of whose bases may be changed from the corresponding base shown in Table 15A or Table 15C while still encoding a protein that maintains its CD39L2-like activities and physiological functions, or a fragment of such a nucleic acids. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 1% of the bases may be so changed.

The disclosed NOV15 protein of the invention includes the CD39L2-like proteins whose sequences are provided in Table 15B and Table 15D. The invention also includes a mutant or variant protein any of whose residues may be changed from the corresponding residue shown in Table 15B or Table 15D while still encoding a protein that maintains its CD39L2-like activities and physiological functions, or a functional fragment thereof. In the mutant or variant protein, up to about 1% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle. Additional SNP variants of NOV15 are disclosed in Examples.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV15a protein has multiple hydrophilic regions, each of which can be used as an immunogen. In one embodiment, a contemplated NOV15a epitope is from about amino acids 1 to 24. In another embodiment, a contemplated NOV15a epitope is from about amino acids 50 to 82. In other specific embodiments, contemplated NOV15a epitopes are from about amino acids 96 to 151, from about amino acids 172 to 188, from about amino acids 254 to 277, from about amino acids 292 to 337, from about amino acids 342 to 366, from about amino acids 396 to 414, from about amino acids 432 to 447, and from about 454 to 467. These novel proteins can be used in assay systems for functional analysis of various human disorders, which will help in understanding of pathology of the disease and development of new drug targets for various disorders. The disclosed NOV15b protein has multiple hydrophilic regions, each of which can be used as an immunogen. In one embodiment, a contemplated NOV15b epitope is from about amino acids 1 to 57. In another embodiment, a contemplated NOV15b epitope is from about amino acids 75 to 132. In other specific embodiments, contemplated NOV15b epitopes are from about amino acids 150 to 163, from about amino acids 232 to 257, from about amino acids 272 to 310, from about amino acids 322 to 345, from about amino acids 375 to 392, from about amino acids 409 to 420, and from about amino acids 431 to 446. These novel proteins can be used in assay systems for functional analysis of various human disorders, which will help in understanding of pathology of the disease and development of new drug targets for various disorders.

The CD39L2 disclosed in this invention is expressed in at least the following tissues: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus, Cerebral Medulla/Cerebral white matter, Coronary Artery, Hair Follicles, Liver, Lung, Lymph node, Ovary, Whole Organism, Colon, Peripheral Blood. This information was derived by determining the tissue sources of the sequences that were included in the invention including but not limited to SeqCalling sources, Public EST sources, Literature sources, and/or RACE sources.

In addition, NOV15 is predicted to be expressed in keratinocytes because of the expression pattern of (GENBANK-ID: gb:GENBANK-ID:AF039916|acc:AF039916.1) a closely related *Homo sapiens* CD39L2 (CD39L2) Mrna, complete cds homolog in species *Homo sapiens*. Additional disease indications and tissue expression for NOV15 and NOV15 variants, if available, are presented in the Examples.

The protein similarity information, expression pattern, and map location for the CD39L2-like protein and nucleic acid disclosed herein suggest that this CD39L2 may have important structural and/or physiological functions characteristic of the nucleoside phosphatase family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention may have efficacy for treatment of patients suffering from thrombosis, atherosclerosis, bleeding predisposition, other cardiovascular diseases associated with dysregulation of platelet functions, seizures, and other diseases, disorders and conditions of the like.

NOV16

A disclosed NOV16 nucleic acid of 1515 nucleotides (also referred to as 61116029_GRAIL)(SEQ ID NO:39) encoding a novel P450-like protein is shown in Table 16A. An open reading frame was identified beginning with an ATG initiation codon at nucleotides 1–3 and ending with a TGA codon at nucleotides 1513–1515. The start and stop codons are in bold in Table 16A.

TABLE 16A

NOV16 nucleotide sequence (SEQ ID NO:39)

ATGGAGGCGACCGGCACCTGGGCGCTGCTGCTGGCGCTGGCGCTGCTCCTGCTGCTGACGCTGGCGCTGT

CCGGGACCAGGGCCCGAGGCCACCTGCCCCCGGGCCCACGCCGCTACCACTGCTGGGAAACCTCCTGCA

GCTACGGCCCGGGCGCTGTATTCAGGGCTCATGCGGCTGAGTAAGAAGTACGGACCGGTGTTCACCATC

TACCTGGGACCGTGGCGGCCTGTGGTGGTCCTGGTTGGGCAGGAGGCTGTGCGGGAGGCCCTGGGAGGTC

AGGCTGAGGAGTTCAGCGGCCGGGGAACCGTAGCGATGCTGGAAGGGACTTTTGATGGCCATGGGGTTTT

CTTCTCCAACGGGAGCGGTGGAGGCAGCTGAGGAAGTTTACCATGCTTGCTCTGCGGGACCTGGGCATG

GGGAAGCGAGAAGGCGAGGAGCTGATCCAGGCGGAGGCCCGGTGTCTGGTGGAGACATTCCAGGGGACAG

AAGGACGCCCATTCGATCCCTCCCTGCTGCTGGCCCAGGCCACCTCCAACGTAGTCTGCTCCCTCCTCTT

TGGCCTCCGCTTCTCCTATGAGGATAAGGAGTTCCAGGCCGTGGTCCGGGCAGCTGGTGGTACCCTGCTG

GGAGTCAGCTCCCAGGGGGGTCAGACCTACGAGATGTTCTCCTGGTTCCTGCGGCCCCTGCCAGGCCCCC

ACAAGCAGCTCCTCCACCACGTCAGCACCTTGGCTGCCTTCACAGTCCGGCAGGTGCAGCAGCACCAGGG

GAACCTGGATGCTTCGGGCCCCGCACGTGACCTTGTCGATGCCTTCCTGCTGAAGATGGCACAGGAGGAA

CAAAACCCAGGCACAGAATTCACCAACAAGAACATGCTGATGACAGTCATTTATTTGCTGTTTGCTGGGA

CGATGACGGTCAGCACCACGGTCGGCTATACCCTCCTGCTCCTGATGAAATACCCTCATGTCCAAAAGTG

GGTACGTGAGGAGCTGAATCGGGAGCTGGGGGCTGGCCAGGCACCAAGCCTAGGGGACCGTACCCGCCTC

CCTTACACCGACGCGGTTCTGCATGAGGCGCAGCGGCTGCTGGCGCTGGTGCCCATGGGAATACCCCGCA

CCCTCATGCGGACCACCCGCTTCCGAGGGTACACCCTGCCCCAGGGCACGGAGGTCTTCCCCCTCCTTGG

CTCCATCCTGCATGACCCCAACATCTTCAAGCACCCAGAAGAGTTCAACCCAGACCGTTTCCTGGATGCA

GATGGACGGTTCAGGAAGCATGAGGCGTTCCTGCCCTTCTCCTTAGGGAAGCGTGTCTGCCTTGGAGAGG

GCCTGGCAAAAGCGGAGCTCTTCCTCTTCTTCACCACCATCCTACAAGCCTTCTCCCTGGAGAGCCCGTG

CCCGCCGGACACCCTGAGCCTCAAGCCCACCGTCAGTGGCCTTTTCAACATTCCCCCAGCCTTCCAGCTG

CAAGTCCGTCCCACTGACCTTCACTCCACCACGCAGACCAGATGA

The P450-like NOV16 disclosed in this invention maps to chromosome 19.

A disclosed NOV16 polypeptide (SEQ ID NO:40) encoded by SEQ ID NO:39 has 505 amino acid residues and is presented in Table 16B using the one-letter code. NOV16 polypeptides are likely Type Ib (Nexo Ccyt) membrane proteins. Analysis of NOV16 with INTEGRAL software predicts a likelihood of −10.93 of having a transmembrane domain at residues 8–24 (1–28). The SignalP, Psort and/or Hydropathy results predict that NOV16 has a signal peptide and is likely to be localized to the endoplasmic reticulum membrane with a certainty of 0.8200. In an alternative embodiment, NOV16 is likely to be localized to the microbody (peroxisome) with a certainty of 0.3200, or to the plasma membrane with a certainty of 0.1900, or to the endoplasmic reticulum lumen with a certainty of 0.1000. The most likely cleavage site for a NOV16 signal peptide is between amino acids 28 and 29, ie., at the dash in the sequence TRA-RG.

TABLE 16B

NOV16 protein sequence (SEQ ID NO:40)

MEATGTWALLLALALLLLLTLALSGTRARGHLPPGPTPLPLLGNLLQLRPGALYSGLMRLSKKYGPVFTI

YLGPWRPVVVLVGQEAVREALGGQAEEFSGRGTVAMLEGTFDGHGVFFSNGERWRQLRKFTMLALRDLGM

GKREGEELIQAEARCLVETFQGTEGRPFDPSLLLAQATSNVVCSLLFGLRFSYEDKEFQAVVRAAGGTLL

GVSSQGGQTYEMFSWFLRPLPGPHKQLLHHVSTLAAFTVRQVQQHQGNLDASGPARDLVDAFLLKMAQEE

QNPGTEFTNKNMLMTVIYLLFAGTMTVSTTVGYTLLLLMKYPHVQKWVREELNRELGAGQAPSLGDRTRL

PYTDAVLHEAQRLLALVPMGIPRTLMRTTRFRGYTLPQGTEVFPLLGSILHDPNIFKHPEEFNPDRFLDA

DGRFRKHEAFLPFSLGKRVCLGEGLAKAELFLFFTTILQAFSLESPCPPDTLSLKPTVSGLFNIPPAFQL

QVRPTDLHSTTQTRX

In a search of sequence databases, it was found, for example, that the nucleic acid sequence of NOV16 has 973 of 1484 bases (65%) identical to a gb:GENBANK-ID:HUMCYIIA4A|acc:M33317.1 Mrna from *Homo sapiens* (Human cytochrome P450IIA4 (CYP2A4) Mrna, complete cds). The full amino acid sequence of the protein of NOV16 was found to have 243 of 482 amino acid residues (50%) identical to, and 340 of 482 amino acid residues (70%) similar to, the 491 amino acid residue ptnr:SWISSPROT-ACC:P04167 protein from *Rattus norvegicus* (CYTOCHROME P450 2B2 (EC 1.14.14.1) (CYPIIB2) (P450E) (P450 PB4)).

In a search of public sequence databases, NOV16 was found to have homology to the amino acid sequences shown in the BLASTP data listed in Table 16C.

TABLE 16C

BLASTP results for NOV16

| Gene Index/ Identifier | Protein/Organism | Length (aa) | Identity (%) | Positives (%) | Expect |
| --- | --- | --- | --- | --- | --- |
| gi\|13449277\|ref\| NP_085125.1\| (NM_030622) | cytochrome P450, subfamily IIS, polypeptide 1; cytochrome P450 family member predicted from ESTs; cytochrome P540, subfamily IIS, polypeptide 1 [*Homo sapiens*] | 504 | 504/504 (100%) | 504/504 (100%) | 0.0 |
| gi\|14042396\|dbj\| BAB55227.1\| (AK027605) | unnamed protein product [*Homo sapiens*] | 564 | 487/487 (100%) | 487/487 (100%) | 0.0 |
| gi\|12836063\| dbj\|BAB23484.1\| (AK004699) | putative [*Mus musculus*] | 501 | 389/496 (78%) | 438/496 (87%) | 0.0 |
| gi\|117254\| sp\|P24461\| CPG1_RABIT | CYTOCHROME P450 2G1 (CYPIIG1) (P450-NMB) (OLFACTIVE) | 494 | 248/491 (50%) | 345/491 (69%) | e-143 |
| gi\|6077097\| dbj\|BAA85463.1\| (D86952) | cytochrome P-450 [*Mesocricetus auratus*] | 494 | 241/481 (50%) | 335/481 (69%) | e-135 |

A multiple sequence alignment is shown in Table 16D, with the protein of the invention being shown on the first line in a ClustalW analysis comparing the protein of the invention with related protein sequences shown in Table 16C.

TABLE 16D

ClustalW Analysis of NOV16

1) NOV16 61116029 (SEQ ID NO:40)
2) gi|13449277| (SEQ ID NO:128)
3) gi|14042396| (SEQ ID NO:129)
4) gi|12836063| (SEQ ID NO:130)
5) gi|117254| (SEQ ID NO:131)
6) gi|6077097| (SEQ ID NO:132)

TABLE 16D-continued

ClustalW Analysis of NOV16

```
                              10         20         30         40         50
                     ....|....|....|....|....|....|....|....|....|....|
NOV16 61116029       MEATGTWALLLAIALLLLLT-LALSGTRARGHLPPGPTPLPLLGNLLQLR
gi|13449277|         MEATGTWALLLAIALLLLLT-LALSGTRARGHLPPGPTPLPLLGNLLQLR
gi|14042396|         MEATGTWALLLAIALLLLLT-LALSGTRARGHLPPGPTPLPLLGNLLQLR
gi|12836063|         MEAASTWALLLALLLLLLLSLTLFRTPARGSLPPGPTPLPLLGNLLQLR
gi|117254|           MELGGAFTIFLALCFSCLLILIAQKRVQKPGRLPPGPTPIPFLGNLLQVR
gi|6077097|          MLASGLLLVTVLAFLVVLXLMSVWKQRKLSGKLPPGPTPLPFIGNYLQLN 60         70         80         90        100
                     ....|....|....|....|....|....|....|....|....|....|
NOV16 61116029       PGALYSGLMRLSKKYGPVGTIYLGPWRPVVVLVGQEAVREALGGQAEEFS
gi|13449277|         PGALYSGLMRLSKKYGPVGTIYLGPWRPVVVLVGQEAVREALGGQAEEFS
gi|14042396|         PGALYSGLMRLSKKYGPVGTIYLGPWRPVVVLVGQEAVREALGGQAEEFS
gi|12836063|         PGALYSGLERLSKKYGPVGTVYLGPWRVVVLVGHEAVREALGGQAEEFS
gi|117254|           TDATEQSFLKLREKYGPVFTVYMGP-RPVVILCGHEAVKEALVDKADEFS
gi|6077097|          TEQMYNSLMKISERYGPVFTIHLGP-RPIVVICGQEAVKEALVDQAEEFS 110        120        130        140        150
                     ....|....|....|....|....|....|....|....|....|....|
NOV16 61116029       GRGTVAMLEGTFDGHGVFFSNGERWRQLRKFIMLALRDLGMGKREGEELI
gi|13449277|         GRGTVAMLEGTFDGHGVFFSNGERWRQLRKFIMLALRDLGMGKREGEELI
gi|14042396|         GRGTVAMLEGTFDGHGVFFSNGERWRQLRKFIMLALRDLGMGKREGEELI
gi|12836063|         GRGTLATLDKTFDGHGVFFANGERWKQLRKFILLALRDLGMGKREGEELI
gi|117254|           GRGELASVERNEQGHGVALANGERWRILRRFSLTILRDFGMGKRSIEERI
gi|6077097|          GRGEQATFDWLEKGYGVAFSSGERAKQLRRESIATLRDFGVGKRGIEERI 160        170        180        190        200
                     ....|....|....|....|....|....|....|....|....|....|
NOV16 61116029       QAEARCLVETFCGTEGRPFDPSILLAQATSNVVCSLLFGLRFSYEDKEFQ
gi|13449277|         QAEARCLVETFCGTEGRPFDPSILLAQATSNVVCSLLFGLRFSYEDKEFQ
gi|14042396|         QAEARCLVETFCGTEGRPFDPSILLAQATSNVVCSLLFGLRFSYEDKEFQ
gi|12836063|         QAEVQSLVEAFQKTEGRPFNPSMLLAQATSNVVCSLVFGIRLPYEDKEFQ
gi|117254|           QEEAGYLIEEFRKTKGAPIDFYFFLSRTVSNVISSVVFGSRFDYEDKQFL
gi|6077097|          QEEAGFLIEEFRKTNGALIDFYFYLSRTVSNVISSTYFGDRFDYEDKEFL 210        220        230        240        250
                     ....|....|....|....|....|....|....|....|....|....|
NOV16 61116029       AVVRAAGTLLGVSSQGGQTYEMFSWFLRPLPGPHKQLLHHVSTLAAFTV
gi|13449277|         AVVRAAGTLLGVSSQGGQTYEMFSWFLRPLPGPHKQLLHHVSTLAAFTV
gi|14042396|         AVVRAAGTLLGVSSQGGQTYEMFSWFLRPLPGPHKQLLHHVSTLAAFTV
gi|12836063|         AVIQAASGTLLCISSPWGQAYEMFSWLLQPLPGPHTQLQHHLGTLAAFTI
gi|117254|           SLLRMINESFIEMSTPWAQLYDMYSGVMQYLPGRHNRIYYLIEELKDFIA
gi|6077097|          SLLRMMLGSFQFTGTSTGQLYEMFSSVMKHLPGPQQQAFKELQGLEDFIT 260        270        280        290        300
                     ....|....|....|....|....|....|....|....|....|....|
NOV16 61116029       RQVQQHQGNLDASGPARDLVDAFLLKMAQEEQNPGTEFTNKNMLMTVRYL
gi|13449277|         RQVQQHQGNLDASGPARDLVDAFLLKMAQEEQNPGTEFTNKNMLMTVRYL
gi|14042396|         RQVQQHQGNLDASGPARDLVDAFLLKMAQEEQNPGTEFTNKNMLMTVRYL
gi|12836063|         QQVQKHQGRFQTSGPARDVVDAFLLKMAQEKQDPGTEFTEKNLLMTVTYL
gi|117254|           ARVKVNEASLDPQNP-RDFIDCFLTKMHQDKNNPHTEFNLKNLVLTTLNL
gi|6077097|          KKVEQNQRTLDPNSP-RDFIDSFLIRMKEEKKNPNTEFYMKNLVLTTLNL 310        320        330        340        350
                     ....|....|....|....|....|....|....|....|....|....|
NOV16 61116029       LFAGTMTVSTTVGYTLLLLMKYPHVQKWVREELNRELGAGQAPSLGDRTR
gi|13449277|         LFAGTMTVSTTVGYTLLLLMKYPHVQKWVREELNRELGAGQAPSLGDRTR
gi|14042396|         LFAGTMTVSTTVGYTLLLLMKYPHVQKWVREELNRELGAGQAPSLGDRTR
gi|12836063|         LFAGTMTIGATIRYALLLLLRYPQVQRVREELIQELGPGRAPSLSDRVR
gi|117254|           FFAGTETVSSTLRYGFLLLIMKHPDEVQTKIYEEINQVFGPHRIPSVDDRVK
gi|6077097|          FFAGTETVSSTLRYGFLLLMKHPDVEAKVQEEIDRVICKNRQPKYEDRLK 360        370        380        390        400
                     ....|....|....|....|....|....|....|....|....|....|
NOV16 61116029       LPYTDAVLHEAQRLLALVPMGIPRTLMRTTFRGYTLPQGTEVFPLLGSI
gi|13449277|         LPYTDAVLHEAQRLLALVPMGIPRTLMRTTFRGYTLPQGTEVFPLLGSI
gi|14042396|         LPYTDAVLHEAQRLLALVPMGIPRTLMRTTFRGYTLPQGTEVFPLLGSI
gi|12836063|         LPYTDAVLHEAQRLLALVPMGMPHTITRTTCFRGYTLPKGTEVFPLIGSI
gi|117254|           MPFTDAVIHPIQRLTDIVPMGVPHNVIRDTTFRGYLLPKGTDVFPLLGSV
gi|6077097|          MPYTSAVIHEIQRFGDMIPMGEARRVTKDTKFRGFFIPKGTEVFPMLGSV 410        420        430        440        450
                     ....|....|....|....|....|....|....|....|....|....|
NOV16 61116029       LHDPNIEKHPEEFNPDRFLDADGRFRKHEAFLPFSLGKRVCLGEGLAKAE
gi|13449277|         LHDPNIEKHPEEFNPDRFLDADGRFRKHEAFLPFSLGKRVCLGEGLAKAE
gi|14042396|         LHDPNIEKHPEEFNPDRFLDADGRFRKHEAFLPFSLGKRVCLGEGLAKAE
gi|12836063|         LHDPAVEQNPEEHPGRFLDEDGRLRKHEAFLPYSLGKRVCLGEGLARAE
gi|117254|           LKDPKYFDDPDEYPQHFLDEQGRFKKNEAFVPFSSKRICLGEAMARME
gi|6077097|          LRDPKFFSNPDEDFNPQHFLDKQGKKNDAFVPFSIGKRYCFGEGLARME
```

TABLE 16D-continued

ClustalW Analysis of NOV16

```
                    460        470        480        490        500
                ....|....|....|....|....|....|....|....|....|....|
NOV16 61116029  LFLFFTTILQAFSLESPCPPDTLSLKPTVSGLFNIPEAPQLQVR------
gi|13449277|    LFLFFTTILQAFSLESPCPPDTLSLKPTVSGLFNIPEAPQLQVR------
gi|14042396|    LFLFFTTILQAFSLESPCPPDTLSLKPTVSGLFNIPPASTVGMDRVNVSR
gi|12836063|    LWLFFISILQAFSLETPCPPGDLSLKPAISGLFNIPEDPQLRVW------
gi|117254|      LFLYFISILQNFSLHPLVPTVNIDITPKISGFGNIPETYELCLI------
gi|6077097|     LFLFLTNILTNFHLRSPQAPQDIDVSPRLVGFATIPPNYTMSFL------

510        520        530        540        550
                ....|....|....|....|....|....|....|....|....|....|
NOV16 61116029  -----------------------------PTDLHSTTQTRX--------
gi|13449277|    -----------------------------PTDLHSTTQTR---------
gi|14042396|    VYTAGSHIYTPAVVFRSLSHGPHAHLTHAAKMHNRTPIHNYKGHKATAGL
gi|12836063|    -----------------------------PTGDQKR-------------
gi|117254|      -----------------------------AR------------------
gi|6077097|     -----------------------------SR------------------

560
                ....|....|....|
NOV16 61116029  ---------------
gi|13449277|    ---------------
gi|14042396|    AFHRHKYSPSAITST
gi|12836063|    ---------------
gi|117254|      ---------------
gi|6077097|     ---------------
```

Other BLAST results include sequences from the Patp database, which is a propriety database that contains sequences published in patents and patent publications. Patp results include those listed in Table 16E.

TABLE 16E

Patp BLASTP Analysis for NOV16

| Sequences producing High-scoring Segment Pairs | Protein/Organism | Length (aa) | Identity (%) | Positive (%) | E Value |
|---|---|---|---|---|---|
| patp: AAU12203 | Human PRO1906 polypeptide sequence - *Homo sapiens* | 504 | 504/504 (100%) | 504/504 (100%) | 9.3e-272 |
| patp: AAB93056 | Human protein sequence clone no: 11860 - *Homo sapiens* | 564 | 487/487 (100%) | 487/487 (100%) | 2.0e-262 |
| patp: AAE03264 | Human gene 9 encoded secreted protein fragment, clone no: 117 - *Homo sapiens* | 277 | 274/274 (100%) | 274/274 (100%) | 4.9e-147 |
| patp: AAR72369 | Human auxillary cytochrome P450 species 2B6 protein - *Homo sapiens* | 491 | 238/487 (48%) | 335/487 (68%) | 3.7e-126 |
| patp: AAR93176 | Human cytochrome P450 molecular species 2B6 protein - *Homo sapiens* | 491 | 238/487 (48%) | 335/487 (68%) | 3.7e-126 |

The presence of identifiable domains in the protein disclosed herein was determined by searches versus domain databases such as Pfam, PROSITE, ProDom, Blocks or Prints and then identified by the Interpro domain accession number. The results indicate that this protein contains the following protein domains (as defined by Interpro) at the indicated positions: domain name IPR001128 at amino acid positions 33 to 493. This indicates that the sequence of the invention has properties similar to those of other proteins known to contain this/these domain(s) and similar to the properties of these domains. Table 16F lists the domain description from DOMAIN analysis results against NOV16.

TABLE 16F

Domain Analysis of NOV16

| Pfam analysis PSSMs producing significant alignments: | Score (bits) | E value |
|---|---|---|

TABLE 16F-continued

Domain Analysis of NOV16 gnl|Pfam|pfam00067 p450, Cytochrome P450. Cytochrome P450s are    387         6e-109
involved in the ox . . .

gnl|Pfam|pfam00067, p450, Cytochrome P450. Cytochrome P450s are involved in the
oxidative degradation of various compounds. Particularly well known for their
role in the degradation of environmental toxins and mutagens. Structure is mostly
alpha, and binds a heme cofactor.
CD-Length = 445 residues, 95.1% aligned
Score = 387 bits (995), Expect = 6e-109

```
NOV16:    54 YSGLMRLSKKYGPVFTIYLGPWRPVVVLVGQEAVREALGGQAEEFSGRGTVAMLEGTFDG 113   (SEQ ID NO:273)
             |  |||||||||+|||||  ||||+ | |||+|  |  + |||+|||    +     + |
Sbjct:    21 IHSLTELRKKYGPVFTLYLGP-RPVVVVTGPEAVKEVLIDKGEEFAGRGDFPVFP--WLG  77   (SEQ ID NO:274)

NOV16:   114 HGVFFSNGERWRQLRKFTMLALRDLGMGKREG-EELIQAEARCLVETFQGTEGRPFDPSL 172
             +|+ ||||  ||||||+  +|  ||   |||||    ||  || ||| |||   + +| | | +
Sbjct:    78 YGILFSNGPRWRQLRR--LLTLRFFGMGKRSKLEERIQEEARDLVERLRKEQGSPIDITE 135

NOV16:   173 LLAQATSNVVCSLLFGLRFSYEDKEFQAVVRAAGGTLLGVSSQGGQTYEMFSWFLRPLPG 232
             ||| |  ||+|||||||+||  |||  ||    ++          ||          ++  |  | |||
Sbjct:   136 LLAPAPLNVICSLLFGVRFDYEDPEFLKLIDKLNELFFLVSP----WGQLLD-FFRYLPG 190

NOV16:   233 PHKQLLHHVSTLAAFTVRQVQQHQGNLDASGPARDLVDAFLLKMAQEEQNPGTEFTNKNM 292
             |++        |   +   + +++  +  |+    | || +|+ |++   +|      |+|  |++ +
Sbjct:   191 SHRKAFKAAKDLKDYLDKLIEERRETLEPGDP-RDFLDSLLIEAKREG---GSELTDEEL 246

NOV16:   293 LMTVIYLLFAGTMTVSTTVGYTLLLLMKYPHVQKWVREELNRELGAGQAPSLGDRTRLPY 352
             ||+ ||||||  |   |+|+ +  |  |+| ||   +|||++  +|   ++|+   ||   +||
Sbjct:   247 KATVLDLLFAGTDTTSSTLSWALYLLAKHPEVQAKLREEIDEVIGRDRSPTYDDRANMPY 306

NOV16:   353 TDAVLHEAQRLLALVPMGIPRTLMRTTRFRGYTLPQGTEVFPLLGSILHDPNIFKHPEEF 412
             |||+ |   ||   +||+ +||      |     || +|+|| |    |+   || +| +||||
Sbjct:   307 LDAVIKETLRLHPVVPLLLPRVATEDTEIDGYLIPKGTLVIVNLYSLHRDPKVFPNPEEF 366

NOV16:   413 NPDRFLDADGRFRKHEAFLPFSLGKRVCLGEGLAKAELFLFFTTILQAFSLESPCPPDTL 472
             +|+||||  +|+|+|   |||||   |  ||||  ||&  |||||   |+||  | ||    |  | +
Sbjct:   367 DPERFLDENGKFKKSYAFLPFGAGPRNCLGERLARMELFLFLATLLQRFELELVPPGD-I 425

NOV16:   473 SLKPTVSGLFNIPPAFQL                                          490
             |  |     ||  +  ||   +||
Sbjct:   426 PLTPKPLGLPSKPPLYQL                                          443
```

The disclosed NOV16 nucleic acid encoding a P450-like protein includes the nucleic acid whose sequence is provided in Table 16A, or a fragment thereof. The invention also includes a mutant or variant nucleic acid any of whose bases may be changed from the corresponding base shown in Table 16A while still encoding a protein that maintains its P450-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 35% of the bases may be so changed.

The disclosed NOV16 protein of the invention includes the P450-like protein whose sequence is provided in Table 16B. The invention also includes a mutant or variant protein any of whose residues may be changed from the corresponding residue shown in Table 16B while still encoding a protein that maintains its P450-like activities and physiological functions, or a functional fragment thereof. In the mutant or variant protein, up to about 50% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV16 protein has multiple hydrophilic regions, each of which can be used as an immunogen. In one embodiment, a contemplated NOV16 epitope is from about amino acids 1 to 9. In another embodiment, a contemplated NOV16 epitope is from about amino acids 27 to 38. In other specific embodiments, contemplated NOV16 epitopes are from about amino acids 55 to 60, from about amino acids 91 to 109, from about amino acids 114 to 175, from about amino acids 195 to 205, from about amino acids 213 to 241, from about amino acids 249 to 268, from about amino acids 273 to 291, from about amino acids 321 to 358, from about amino acids 374 to 391, from about amino acids 401 to 436, from about amino acids 468 to 475, and from about amino acids 490 to 505. These novel proteins can be used in assay systems for functional analysis of various human disorders, which will help in understanding of pathology of the disease and development of new drug targets for various disorders.

The P450 disclosed in this invention is expressed in at least the following tissues: liver. This information was derived by determining the tissue sources of the sequences that were included in the invention including but not limited to SeqCalling sources, Public EST sources, Literature sources, and/or RACE sources.

In addition, the sequence is predicted to be expressed in the following tissues because of the expression pattern of (GENBANK-ID: gb:GENBANK-ID:HUMCYIIA4A|acc:M33317.1) a closely related Human cytochrome P450IIA4 (CYP2A4) Mrna, complete cds homolog in species Homo sapiens: liver. Additional disease indications and tissue expression for NOV16 and NOV16 variants, if available, are presented in the Examples.

The protein similarity information, expression pattern, and map location for the P450-like protein and nucleic acid disclosed herein suggest that this P450 may have important structural and/or physiological functions characteristic of the Cytochrome P450 family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies.

NOV17

A disclosed NOV17 nucleic acid of 1185 nucleotides (also referred to as AC004596_A) (SEQ ID NO:41) encoding a novel CG13379-like protein is shown in Table 17A. An open reading frame was identified beginning with an ATG initiation codon at nucleotides 1–3 and ending with a TGA codon at nucleotides 1183–1185. The start and stop codons are shown in bold in Table 17A.

TABLE 17A

NOV17 nucleotide sequence (SEQ ID NO:41)

ATGGGTATCAAAGAGGGGTTTGAGTTTTGGGGACCTAGGCCGTGTTGCCGCCCGCTGTGCTATGAGCAGT

CAGAGCGCCGTCTCCACAAGAGTTTACAAATGAAAATGGAGGAAATGTCTTTGTCTGGCCTGGATAACAG

CAAACTAGAGATGTTCTCCCCTGGGGCCCAGGCCATCGCTCAGGAGATATACGCGGACCTGGTCGAGGAT

TCTTGTTTGGGATTCTGCTTTGAGGTACACCGGGCTGTCAAGTGTGGCTACTTCTTCTTGGACGACACGG

ACCCTGATAGCATGAAGGATTTTGAGATCGTGGACCAGCCGGGCTTGGACATCTTTGGACAGGTTTTCAA

CCAGTGGAAGAGCAAGGAGTGTGTTTGCCCCAATTGCAGTCGCAGCATTGCCGCCTCCCGCTTTGCTCCC

CATCTGGAGAAGTGCCTGGGAATGGGTCGGAACAGCAGCCGAATCGCCAACCGCCGGATTGCCAATAGCA

ACAATATGAATAAGTCTGAGAGTGACCAAGAAGATAATGATGACATCAATGACAACGACTGGTCCTATGG

CTCGGAGAAGAAAGCCAAGAAGAGAAAGTCAGACAAGCTATGGTATCTCCCATTCCAGAACCCCAATTCC

CCTCGAAGATCCAAGTCATTAAAACACAAAAATGGGGAACTTAGCAATTCGGATCCTTTTAAGTATAACA

ATTCAACTGGGATCAGCTATGAGACCCTGGGGCCGGAGGAGCTTCGCAGCCTGCTAACCACGCAATGTGG

GGTGATTTCTGAACACACCAAGAAGATGTGCACAAGGTCCCTGCGCTGCCCACAGCACACAGATGAGCAG

AGGCGAACCGTACGGATTTATTTTCTCGGGCCCTCGGCTGTCCTTCCAGAGGTCGAGAGCTCCCTGGATA

ATGACAGCTTTGACATGACTGACAGCCAGGCCCTGATCAGCCGGCTTCAGTGGGACGGCTCCTCTGACCT

CTCACCCTCTGATTCAGGCTCCTCCAAGACGAGTGAAAATCAGGGATGGGGTCTAGGTACCAACAGCTCT

GAGTCACGGAAAACCAAGAAAAAGAAATCCCATCTGAGCCTGGTAGGGACTGCCTCCGGCCTAGGTTCCA

ACAAGAAGAAGAAGCCAAAGCCACCGGCACCCCCGACGCCCAGCATCTATGATGACATCAACTGA

The CG13379-like NOV17 disclosed in this invention maps to chromosome 17.

A disclosed NOV17 polypeptide (SEQ ID NO:42) encoded by SEQ ID NO:41 394 amino acid residues and is presented in Table 17B using the one-letter code. The SignalP, Psort and/or Hydropathy results predict that NOV17 has no signal peptide and is likely to be localized in the nucleus with a certainty of 0.7000 predicted by PSORT. In an alternative embodiment, NOV17 is likely to be localized to the microbody (peroxisome) with a certainty of 0.3000, or to the mitochondrial matrix space with a certainty of 0.1000, or to the lysosome lumen with a certainty of 0.1000.

TABLE 17B

NOV17 protein sequence (SEQ ID NO:42)

MGIKEGFEFWGPRPCCRPLCYEQSERRLHKSLQMKMEEMSLSGLDNSKLEMFSPGAQAIAQEIYADLVED
SCLGFCFEVHRAVKCGYFFLDDTDPDSMKDFEIVDQPGLDIFGQVFNQWKSKECVCPNCSRSIAASRFAP
HLEKCLGMGRNSSRIANRRIANSNNMNKSESDQEDNDDINDNDWSYGSEKKAKKRKSDKLWYLPFQNPNS
PRRSKSLKHKNGELSNSDPFKYNNSTGISYETLGPEELRSLLTTQCGVISEHTKKMCTRSLRCPQHTDEQ
RRTVRIYFLGPSAVLPEVESSLDNDSFDMTDSQALISRLQWDGSSDLSPSDSGSSKTSENQGWGLGTNSS
ESRKTKKKKSHLSLVGTASGLGSNKKKKPKPPAPPTPSIYDDIN

In a search of sequence databases, the full amino acid sequence of NOV17 of the invention was found to have 60 of 135 amino acid residues (44%) identical to, and 79 of 135 amino acid residues (58%) similar to, the 223 amino acid residue ptnr:SPTREMBL-ACC:Q9VVR6 protein from Drosophila melanogaster (CG13379 PROTEIN).

In a search of public sequence databases, NOV17 was found to have homology to the amino acid sequences shown in the BLASTP data listed in Table 17C.

TABLE 17C

BLASTP results for NOV17

| Gene Index/ Identifier | Protein/Organism | Length (aa) | Identity (%) | Positives (%) | Expect |
|---|---|---|---|---|---|
| Gi\|16550875\| dbj\|BAB71070.1\| (AK056002) | unnamed protein product [*Homo sapiens*] | 222 | 212/229 (92%) | 213/229 (92%) | 4e−92 |
| gi\|9368849\| emb\|CAB99093.1\| (AL390158) | hypothetical protein [*Homo sapiens*] | 187 | 187/187 (100%) | 187/187 (100%) | 1e−87 |
| gi\|14772535\|ref\| XP_046017.1\| (XM_046017) | hypothetical protein DKFZp761G2113 [*Homo sapiens*] | 129 | 129/129 (100%) | 129/129 (100%) | 8e−56 |
| gi\|7293878\|gb\| AAF49243.1\| (AE003519) | CG13379 gene product [*Drosophila melanogaster*] | 223 | 66/175 (37%) | 89/175 (50%) | 2e−19 |
| gi\|8843778\| dbj\|BAA97326.1\| (AB020755) | emb\|CAB85555.1~gene_id: MZN1.2~similar to unknown protein [*Arabidopsis thaliana*] | 517 | 42/131 (32%) | 56/131 (42%) | 4e−09 |

A multiple sequence alignment is shown in Table 17D, with the protein of the invention being shown on the first line in a ClustalW analysis comparing the protein of the invention with related protein sequences shown in Table 17C.

TABLE 17D

ClustalW Analysis of NOV17

1) NOV17 AC004596_A (SEQ ID NO:42)
2) gi|16550875| (SEQ ID NO:133)
3) gi|9368849| (SEQ ID NO:134)
4) gi|14772535| (SEQ ID NO:135)
5) gi|7293878| (SEQ ID NO:136)
6) gi|8843778| (SEQ ID NO:137)

```
                              10        20        30        40        50
                     ....|....|....|....|....|....|....|....|....|....|
NOV17 AC004596_A     MGIKEGFEFWGPRPCCRPLCYEQSERRLHKSLQMKMEEMSLSGLDNSKLE
gi|16550875|         --------------------------------------------------
gi|9368849|          --------------------------------------------------
gi|14772535|         --------------------------------------------------
gi|7293878|          --------------------------------------------------
gi|8843778|          ---------MATTSTTTKLSVLCCSFISSPLVDSPPSLAFFSPIPRFLTV
```

TABLE 17D-continued

ClustalW Analysis of NOV17

```
                        60         70         80         90        100
                 ....|....|....|....|....|....|....|....|....|....|
NOV17 AC004596_A MFSPGAQAIAQEIYADLVEDSCLGFCFEVHRAVKCGYFFLDDTDPDSMKD
gi|16550875|     --------------------------------------------------
gi|9368849|      --------------------------------------------------
gi|14772535|     --------------------------------------------------
gi|7293878|      --------------------------------------------------
gi|8843778|      RIATSFRSSSRFPATKIRKSSLAAVMFPENSVLSDVCAFGVTSIVAFSCL 110        120        130        140        150
                 ....|....|....|....|....|....|....|....|....|....|
NOV17 AC004596_A FEIVDQPGLDIFGQVFNQWKSKECVCPNCSRSIAASRFAPHLEKCLGMGR
gi|16550875|     --------------------------------------------------
gi|9368849|      --------------------------------------------------
gi|14772535|     --------------------------------------------------
gi|7293878|      --------------------------------------------------
gi|8843778|      GFWGEIGKRGIFDQKLIRKLVHINIGLVFMLCWPLFSSGIQGALFASLVP 160        170        180        190        200
                 ....|....|....|....|....|....|....|....|....|....|
NOV17 AC004596_A NSSRIANRRIANSNNMNKSESDQEDNDD-------------INDNDWSYG
gi|16550875|     -------------------MNKSESDQEDNDD-------------INDNDWSYG
gi|9368849|      --------------------------------------------------
gi|14772535|     --------------------------------------------------
gi|7293878|      -----------------------MSAAN--------------MPTTTGAQG
gi|8843778|      GLNIVRMLLLGLGVYHDEGTIKSMSRHGDRRELLKGPLYYVLSITSACIY 210        220        230        240        250
                 ....|....|....|....|....|....|....|....|....|....|
NOV17 AC004596_A SEKKAKKRKSDKLWYLP-FQNPNSP-------RRSKSLKHKNG-------
gi|16550875|     SEKKAKKRKSD--------KNPNSP-------RRSKSLKHKNG-------
gi|9368849|      ---------------------PNSP-------RRSKSLKHKNG-------
gi|14772535|     --------------------------------------------------
gi|7293878|      SGNQVPTTSTTIVN-----HFRELI-------KEPKNLDEAAN-------
gi|8843778|      YWKSSPIAIAVICNLCAGDGMADIVGRRFGTEKLPYNKNKSFAGSIGMAT 260        270        280        290        300
                 ....|....|....|....|....|....|....|....|....|....|
NOV17 AC004596_A ----------ELSNSDPFKYNN--------STGISYETLGPEELRDLLTTQ
gi|16550875|     ----------ELSNSDPFKYNN--------STGISYETLGPEELRDLLTTQ
gi|9368849|      ----------ELSNSDPFKYNN--------STGISYETLGPEELRDLLTTQ
gi|14772535|     --------------------------------------------------
gi|7293878|      ----------YLYQS--LLDDA--------VVGIFNETHHLRKS-GNLAAL
gi|8843778|      AGFLASVAYMYYFASFGYIEDSGGMILRFLVGEVTVTAFQTRKQHEEQEE 310        320        330        340        350
                 ....|....|....|....|....|....|....|....|....|....|
NOV17 AC004596_A CGVISEHTK-------------------------------KMCTRS---
gi|16550875|     CGVISEHTK-------------------------------KMCTRS---
gi|9368849|      CGVISEHTK-------------------------------KMCTRS---
gi|14772535|     -----------------------------------------MCTRS---
gi|7293878|      DGVPEDSTY-------------------------------RMCEMPNLD
gi|8843778|      DGEADDKNYRQDLTMHGVVSVSSEIMIGGFFADVKFNRSREKKLSLPPPF 360        370        380        390        400
                 ....|....|....|....|....|....|....|....|....|....|
NOV17 AC004596_A ---LRCPQHTDEQRRTVRIYFLGPSAVLPEVESSLDNDS-FDMTDSQALI
gi|16550875|     ---LRCPQHTDEQRRTVRIYFLGPSAVLPEVESSLDNDS-FDMTDSQALI
gi|9368849|      ---LRCPQHTDEQRRTVRIYFLGPSAVLPEVESSLDNDS-FDMTDSQALI
gi|14772535|     ---LRCPQHTDEQRRTVRIYFLGPSAVLPEVESSLDNDS-FDMTDSQALI
gi|7293878|      IFGISTAKKPMLCTCPNCDRLVAAARFAPHLEKCMGMGR-ISSRIASRRI
gi|8843778|      TVATRLYSLSSQIFLDLVDSVIADVASECHRVARLGLDRDLDIVEEELRI 410        420        430        440        450
                 ....|....|....|....|....|....|....|....|....|....|
NOV17 AC004596_A SRLQWDGSSDLSPS-DS---------GSSKT-------------------
gi|16550875|     SRLQWDGSSDLSPS-DS---------GSSKT-------------------
gi|9368849|      SRLQWDGSSDLSPS-DS---------GSSKT-------------------
gi|14772535|     SRLQWDGSSDLSPS-DS---------GSSKT-------------------
gi|7293878|      ATKEGATSAHLHSSGNT---------GGTDD-------------------
gi|8843778|      SVEARAKIADPSNNLETNTKYVVDIFGQTHPPVASEVFNCMNCGRQIVAG 460        470        480        490        500
                 ....|....|....|....|....|....|....|....|....|....|
NOV17 AC004596_A --SENQGWGLGTNSSESRKTKKKKSHLSLVGTASGLGSNKKKKPKPPA--
gi|16550875|     --SENQGWGLGTNSSESRKTKKKKSHLSLVGTASGLGSNKKKKPKPPA--
gi|9368849|      --SENQGWGLGTNSSESRKTKKKKSHLSLVGTASGLGSNKKKKPKPPA--
gi|14772535|     --SENQGWGLGTNSSESRKTKKKKSHLSLVGTASGLGSNKKKKPKPPA--
gi|7293878|      --EDDVDWSSDKRRKKSNQNSRNNGSKKNNGKTFYDHPYWRTPPIPPS--
gi|8843778|      RFAPHLEKCMGKGRKARAKTTRSTIAAQNRNARRSPNPRYSPYPNSASEN
```

TABLE 17D-continued

ClustalW Analysis of NOV17

```
                          510        520
                   ....|....|....|....|....|.
NOV17 AC004596_A   PPTPS-------IYDDIN--------
gi|16550875|       PPTPS-------IYDDIN--------
gi|9368849|        PPTPS-------IYDDIN--------
gi|14772535|       PPTPS-------IYDDIN--------
gi|7293878|        SLDNG-------NSNGIVIN------
gi|8843778|        QLASGSPGVAGEDCSNGTVRENVKGD
```

Other BLAST results include sequences from the Patp database, which is a proprietary database that contains sequences published in patents and patent publications. Patp results include those listed in Table 17E.

TABLE 17E

Patp BLASTP Analysis for NOV17

| Sequences producing High-scoring Segment Pairs | Protein/Organism | Length (aa) | Identity (%) | Positive (%) | E Value |
|---|---|---|---|---|---|
| patp: AAM95704 | Human reproductive system related antigen clone no: 4362 - *Homo sapiens* | 122 | 117/121 (96%) | 117/121 (96%) | 4.0e−58 |
| patp: AAB25085 | Plant SDF encoded polypeptide sequence clone no: 146 - Plant | 181 | 47/140 (33%) | 64/140 (45%) | 3.0e−09 |
| patp: AAB25047 | Plant SDF encoded polypeptide sequence clone no: 92 - Plant | 132 | 43/121 (35%) | 59/121 (48%) | 3.7e−08 |
| patp: AAG70812 | *S cerevisiae* apoptosis associated protein YOR369C - *Saccharomyces cerevisiae* | 99 | 20/55 (36%) | 29/55 (52%) | 0.0013 |
| patp: AAB41835 | Human ORFX ORF1599 polypeptide sequence clone no: 3198 - *Homo sapiens* | 833 | 51/178 (28%) | 78/178 (43%) | 0.022 |

The presence of identifiable domains in the protein disclosed herein was determined by searches versus domain databases such as Pfam, PROSITE, ProDom, Blocks or Prints and then identified by the Interpro domain accession number. Table 17F lists the domain description from DOMAIN analysis results against NOV17.

TABLE 17F

Domain Analysis of NOV17

Pfam analysis
NO DOMAINS DETECTED

The disclosed NOV17 nucleic acid encoding a CG13379-like protein includes the nucleic acid whose sequence is provided in Table 17A, or a fragment thereof. The invention also includes a mutant or variant nucleic acid any of whose bases may be changed from the corresponding base shown in Table 17A while still encoding a protein that maintains its CG13379-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 56% of the bases may be so changed.

The disclosed NOV17 protein of the invention includes the CG13379-like protein whose sequence is provided in Table 17B. The invention also includes a mutant or variant protein any of whose residues may be changed from the corresponding residue shown in Table 17B while still encoding a protein that maintains its CG13379-like activities and physiological functions, or a functional fragment thereof. In the mutant or variant protein, up to about 56% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV17 protein has multiple hydrophilic regions, each of which can be used as an immunogen. In one embodiment, a contemplated NOV17 epitope is from about amino acids 1 to 57. In another embodiment, a contemplated NOV17 epitope is from about amino acids 86 to 106. In other specific embodiments, contemplated NOV17 epitopes are from about amino acids 110 to 137, from about amino acids 142 to 289, and from about amino acids 297 to 394. These novel proteins can be used in assay systems for functional analysis of various human disorders, which will help in understanding of pathology of the disease and development of new drug targets for various disorders.

The CG13379 disclosed in this invention is expressed in at least the following tissues: adipose, skeletal muscle, liver, and brain. This information was derived from expression data from animal studies done by Curagen. Restriction fragments unique to the coding sequence of the protein of the invention were discovered in cDNA derived from metabolic tissues in rat models of obesity, hyperlipidemia, Type II diabetes and the Metabolic Syndrome X. Additional disease indications and tissue expression for NOV17 and NOV17 variants, if available, are presented in the Examples.

The nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from: Dyslipidemia, insulin resistance, obesity, hypertension and other conditions associated with the Metabolic Syndrome X and disorders of the like.

NOV18

A disclosed NOV18 nucleic acid of 2193 nucleotides (also referred to as AC073079_C) (SEQ ID NO:43) encoding a novel Calcium transporter-like protein is shown in Table18A. An open reading frame was identified beginning with an ATG initiation codon at nucleotides 1–3 and ending with a TGA codon at nucleotides 2191–2193. The start and stop codons are in bold in Table 18A.

TABLE 18A

| NOV18 nucleotide sequence (SEQ ID NO:43) |
|---|
| ATGGGGGGTTTTCTACCTAAGGCAGAAGGGCCCGGGAGCCAACTCCAGAAACTTCTGCCCTCCTTTCTGG |
| TCAGAGAACAAGACTGGGACCAGCACCTGGACAAGCTTCATATGCTGCAGCAGAAGAGGATTCTAGAGTC |
| TCCACTGCTTCGAGCATCCAAGGAAAATGACCTGTCTGTTCTTAGGCAACTTCTACTGGACTGCACCTGT |
| GACGTTCGACAAAGAGGTGGAGCCCTGGGGGAGACGGCGCTGCACATAGCAGCCCTCTATGACAACTTGG |
| AGGCGGCCTTGGTGCTGATGGAGGCTGCCCCAGAGCTGGTCTTTGAGCCCACCACATGTGAGGCTTTTGC |
| AGGTCAGACTGCACTGCACATCGCTGTTGTGAACCAGAATGTGAACCTGGTGCGTGCCCTGCTCACCCGC |
| AGGGCCAGTGTCTCTGCCAGAGCCACAGGCACTGCCTTCCGCCGTAGTCCCCGCAACCTCATCTACTTTG |
| GGGAGCACCCTTTGTCCTTTGCTGCCTGTGTGAACAGCGAGGAGATCGTGCGGCTGCTCATTGAGCATGG |
| AGCTGACATCAGGGCCCAGGACTCCCTGGGAAACACAGTATTACACATCCTCATCCTCCAGCCCAACAAA |
| ACCTTTGCCTGCCAGATGTACAACCTGCTGCTGTCCTACGATGGACATGGGGACCACCTGCAGCCCCTGG |
| ACCTTGTGCCCAATCACCAGGGTCTCACCCCCTTCAAGCTGGCTGGAGTGGAGGGTAACACTGTGATGTT |
| CCAGCACCTGATGCAGAAGCGGAGGCACATCCAGTGGACGTATGGACCCCTGACCTCCATTCTCTACGAC |
| CTCACAGAGATCGACTCCTGGGGAGAGGAGCTGTCCTTCCTGGAGCTTGTGGTCTCCTCTGATAAACGAG |
| AGGCTCGCCAAATTCTGGAACAGACCCCAGTGAAGGAGCTGGTGAGCTTCAAGTGGAACAAGTATGGCCG |
| GCCGTACTTCTGCATCCTGGCTGCCTTGTACCTGCTCTACATGATCTGCTTTACCACGTGCTGCGTCTAC |
| CGCCCCCTTAAGTTTCGTGGTGGCAACCGCACTCATTCTCGAGACATCACCATCCTCCAGCAAAAACTAC |
| TACAGGAGGCCTATGAGACACGTGAAGATATCATCAGGCTGGTGGGGGAGCTGGTGAGCATCGTTGGGGC |
| TGTGATCATCCTGCTCCTAGAGATTCCAGACATCTTCAGGGTTGGTGCCTCTCGCTATTTTGGAAAGACG |
| ATTCTTGGGGGCCATTCCATGTCATCATGATCACCTATGCCTCCCTGGTGCTGGTGACCATGGTGATGC |
| GGCTCACCAACACCAATGGGGAGGTGGTGCCCATGTCCTTTGCCCTGGTGCTGGGCTGGTGCAGTGTCAT |
| GTATTTCACTCGAGGATTCCAGATGCTGGGTCCCTTCACCATCATGATCCAGAAGATGATTTTTGGAGAC |

TABLE 18A-continued

NOV18 nucleotide sequence (SEQ ID NO:43)

```
CTAATGCGTTTCTGCTGGCTGATGGCTGTGGTCATCTTGGGATTTGCCTCCGCGTTCTATATCATTTTCC
AGACAGAGGACCCAACCAGTCTGGGGCAATTCTATGACTACCCCATGGCACTGTTCACCACCTTTGAGCT
TTTTCTCACTGTTATTGATGCACCTGCCAACTACGACGTGGACTTGCCCTTCATGTTCAGCATTGTCAAC
TTCGCCTTCGCCATCATTGCCACACTGCTCATGCTCAACTTGTTCATCGCCATGATGGGCGACACCCACT
GGAGGGTGGCCCAGGAGAGGGATGAGCTCTGGAGGGCCCAGGTCGTGGCCACCACAGTGATGCTGGAGCG
GAAGCTGCCTCGCTGCCTGTGGCCTCGCTCCGGGATCTGTGGGTGCGAATTCGGGCTGGGGGACCGCTGG
TTCCTGCGGGTTGAGAACCACAATGATCAGAATCCTCTGCGAGTGCTTCGCTATGTGGAAGTGTTCAAGA
ACTCAGACAAGGAGGATGACCAGGAGCATCCATCTGAGAAACAGCCCTCTGGGGCTGAGAGTGGGACTCT
AGCCAGAGCCTCTTTGGCTCTTCCAACTTCCTCCCTGTCCCGGACCGCGTCCCAGAGCAGCAGTCACCGA
GGCTGGGAGATCCTTCGTCAAAACACCCTGGGGCACTTGAATCTTGGACTGAACCTTAGTGAGGGGATG
GAGAGGAGGTCTACCATTTTTGA
```

The Calcium transporter-like NOV18 disclosed in this invention maps to chromosome 7.

A disclosed NOV18 polypeptide (SEQ ID NO:44) encoded by SEQ ID NO:43 has 730 amino acid residues and is presented in Table 18B using the one-letter code. NOV18 polypeptides are likely Type IIIb (Nexo Ccyt) membrane proteins. Analysis of NOV18 with INTEGRAL software predicts a likelihood of −10.14 of having a transmembrane domain at residues 387–403 (383–414), a likelihood of −8.39 of having a transmembrane domain at residues 497–513 (486–516), a likelihood of −8.01 of having a transmembrane domain at residues 561–577 (550–582), a likelihood of −4.99 of having a transmembrane domain at residues 330–346 (327–350), a likelihood of −4.35 of having a transmembrane domain at residues 426–442 (421–446), and a likelihood of −1.38 of having a transmembrane domain at residues 452–468 (451–469). The SignalP, Psort and/or Hydropathy results predict that NOV18 is likely to be localized at the plasma membrane with a certainty of 0.6000. In an alternative embodiment, NOV18 is likely to be localized to the Golgi body with a certainty of 0.4000, or to the endoplasmic reticulum membrane with a certainty of 0.3000, or to the mitochondrial inner membrane with a certainty of 0.0300.

TABLE 18B

NOV18 protein sequence (SEQ ID NO:44)

```
MGGFLPKAEGPGSQLQKLLPSFLVREQDWDQHLDKLHMLQQKRILESPLLRASKENDLSVLRQLLLDCTC
DVRQRGGALGETALHIAALYDNLEAALVLMEAAPELVFEPTTCEAFAGQTALHIAVVNQNVNLVRALLTR
RASVSARATGTAFRRSPRNLIYFGEHPLSFAACVNSEEIVRLLIEHGADIRAQDSLGNTVLHILILQPNK
TFACQMYNLLLSYDGHGDHLQPLDLVPNHQGLTPFKLAGVEGNTVMFQHLMQKRRHIQWTYGPLTSILYD
LTEIDSWGEELSFLELVVSSDKREARQILEQTPVKELVSFKWNKYGRPYFCILAALYLLYMICFTTCCVY
RPLKFRGGNRTHSRDITILQQKLLQEAYETREDIIRLVGELVSIVGAVIILLLEIPDIFRVGASRYFGKT
ILGGPFHVIMITYASLVLVTMVMRLTNTNGEVVPMSFALVLGWCSVMYFTRGFQMLGPFTIMIQKMIFGD
LMRFCWLMAVVILGFASAFYIIFQTEDPTSLGQFYDYPMALFTTFELFLTVIDAPANYDVDLPFMFSIVN
FAFAIIATLLMLNLFIAMMGDTHWRVAQERDELWRAQVVATTVMLERKLPRCLWPRSGICGCEFGLGDRW
FLRVENHNDQNPLRVLRYVEVFKNSDKEDDQEHPSEKQPSGAESGTLARASLALPTSSLSRTASQSSSHR
GWEILRQNTLGHLNLGLNLSEGDEEVYHF
```

In a search of sequence databases, it was found, for example, that the nucleic acid sequence of NOV18 has 2129 of 2193 bases (97%) identical to a gb:GENBANK-ID:HSA271207|acc:AJ271207.1 Mrna from *Homo sapiens* (*Homo sapiens* Mrna for epithelial calcium channel (ECAC1 gene)). The full amino acid sequence of the protein of NOV18 was found to have 708 of 730 amino acid residues (96%) identical to, and 716 of 730 amino acid residues (98%) similar to, the 729 amino acid residue ptnr:SPTREMBL-ACC:Q9NQA5 protein from *Homo sapiens* (EPITHELIAL CALCIUM CHANNEL).

In a search of public sequence databases, NOV18 was found to have homology to the amino acid sequences shown in the BLASTP data listed in Table 18C.

TABLE 18C

BLASTP results for NOV18

| Gene Index/ Identifier | Protein/Organism | Length (aa) | Identity (%) | Positives (%) | Expect |
|---|---|---|---|---|---|
| gi\|9789941\|ref\| NP_062815.1\| (NM_019841) | epithelial calcium channel 1 [Homo sapiens] | 729 | 708/730 (96%) | 716/730 (97%) | 0.0 |
| gi\|9186904\|dbj\| BAA99541.1\|(AB032019) | epithelial calcium channel [Rattus norvegicus] | 723 | 578/721 (80%) | 642/721 (88%) | 0.0 |
| gi\|16758628\| ref\|NP_446239.1\| (NM_053787) | epithelial calcium channel 1 [Rattus norvegicus] | 723 | 580/721 (80%) | 644/721 (88%) | 0.0 |
| gi\|4581491\|emb\| CAB40138.1\|(AJ133128) | epithelial calcium channel [Oryctolagus cuniculus] | 730 | 610/731 (83%) | 661/731 (89%) | 0.0 |
| gi\|16161319\| ref\|XP_056971.1\| (XM_056971) | similar to calcium transport protein CaT2 (H. sapiens) [Homo sapiens] | 729 | 728/730 (99%) | 729/730 (99%) | 0.0 |

A multiple sequence alignment is shown in Table 18D, with the protein of the invention being shown on the first line in a ClustalW analysis comparing the protein of the invention with related protein sequences shown in Table 18C.

TABLE 18D

ClustalW Analysis of NOV18

1) NOV18 AC073079_C (SEQ ID NO:44)
2) gi|9789941| (SEQ ID NO:138)
3) gi|9186904| (SEQ ID NO:139)
4) gi|16758628| (SEQ ID NO:140)
5) gi|4581491| (SEQ ID NO:141)
6) gi|16161319| (SEQ ID NO:142)

```
                                 10        20        30        40        50
                         ....|....|....|....|....|....|....|....|....|....|
NOV18 AC073079_C         MGGFLPKAEGPGSQLQKLLPSELVREQDWQOHLDKLHMLQQKRILESPLL
gi|9789941|              MGGFLPKAEGPGSQLQKLLPSELVREQDWQOHLDKLHMLQQKRILESPLL
gi|9186904|              MG-----VKKPWIQLQKRLN-WWVREQDWNQHVDQLHMLQQKSIWESPLL
gi|16758628|             MG-----VKKPWIQLQKRLN-WWVREQDWNQHVDQLHMLQQKSIWESPLL
gi|4581491|              MGACPPKAKGPWAQLQKLLISWPVGEQDWEQIRDRVNMLQQERIRESPLL
gi|16161319|             MGGFLPKAEGPGSQLQKLLPSELVREQDWQOHLDKLHMLQQKRILESPLL 60        70        80        90       100
                         ....|....|....|....|....|....|....|....|....|....|
NOV18 AC073079_C         RASKENDLSVLRQLLLDCTCDVRQRGGALGETALHIAALYDNLEAAKVLM
gi|9789941|              RASKENDLSVLRQLLLDCTCDVRQRGGALGETALHIAALYDNLEAALVLM
gi|9186904|              RAAKENDMCTLKRLQHDQNCDFRQRG-ALGETALHVAALYDNLAAAIMLM
gi|16758628|             RAAKENDMCTLKRLQHDQNCDFRQRG-ALGETALHVAALYDNLAAAIMLM
gi|4581491|              QAAKENDLRLLKILLLNQSCDFQQRG-AVGETALHVAALYDNLEAATLLM
gi|16161319|             RASKENDLSVLRQLLLDCTCDVRQRGGALGETALHIAALYDNLEAAKVLM 110       120       130       140       150
                         ....|....|....|....|....|....|....|....|....|....|
NOV18 AC073079_C         EAAPELVFEPTTCEAFAGQTALHIAVVNQNVNLVRALLTRRASVSARATG
gi|9789941|              EAAPELVFEPTTCEAFAGQTALHIAVVNQNVNLVRALLARRASVSARATG
gi|9186904|              ETAPYLVTESTLCEPEVGQTALHIAIMNQNVNLVRALLARGASASARATG
gi|16758628|             ETAPYLVTESTLCEPEVGQTALHIAIMNQNVNLVRALLARGASASARATG
gi|4581491|              EAAPELAKEEALCEPEVGQTALHIAVMNQNLNLVRALLARGASVSARATG
gi|16161319|             EAAPELVFEPTTCEAFAGQTALHIAVVNQNVNLVRALLTRRASVSARATG 160       170       180       190       200
                         ....|....|....|....|....|....|....|....|....|....|
NOV18 AC073079_C         TAFRRSPRNLIYFGEHPLSFAACVNSEEIVRLLIEHGADIRAQDSLGNTV
gi|9789941|              TAFRRSPCNLIYFGEHPLSFAACVNSEEIVRLLIEHGADIRAQDSLGNTV
gi|9186904|              SAFHRSSHNLIYYGEHPLSFAACVSEEIVRLLIEHGADIRAQDSLGNTV
gi|16758628|             SAFHRSSHNLIYYGEHPLSFAACVGSEEIVRLLIEHGADIRAQDSLGNTV
gi|4581491|              AAFRRSPHNLIYYGEHPLSFAACVGSEEIVRLLIEHGADIRAQDSLGNTV
gi|16161319|             TAFRRSPRNLIYFGEHPLSFAACVNSEEIVRLLIEHGADIRAQDSLGNTV
```

TABLE 18D-continued

ClustalW Analysis of NOV18

```
                        210        220        230        240        250
                   ....|....|....|....|....|....|....|....|....|....|
NOV18 AC073079_C   LHILILQPNKTFACQMYNLLLSYDGHGDHLQPLDLVPNHQGLTPFKLAGV
gi|9789941|        LHILILQPNKTFACQMYNLLLTYDRHGDHLQPLDLVPNHQGLTPFKLAGV
gi|9186904|        LHILVLQPNKTFACQMYNLLLSHDG-GDHIKSLELVPNNQGLTPFKLAGV
gi|16758628|       LHILVLQPNKTFACQMYNLLLSHDG-GDHIKSLELVPNNQGLTPFKLAGV
gi|4581491|        LHILILQPNKTFACQMYNLLLSYDEHSDHLQSLELVPNHQGLTPFKLAGV
gi|16161319|       LHILILQPNKTFACQMYNLLLSYDGHGDHLQPLDLVPNHQGLTPFKLAGV 260        270        280        290        300
                   ....|....|....|....|....|....|....|....|....|....|
NOV18 AC073079_C   EGNTVMFQHLMQKFRHIQWTYGPLTSILYDLTEIDSWGEELSFLELVVSS
gi|9789941|        EGNTVMFQHLMQKRKHVQWTCGPLTSLYDLTEIDSWGEELSFLELVVSS
gi|9186904|        EGNTVMFQHLMQKRIHIQWSLGPLTSSIYDLTEIDSWGEDLSFLELVESS
gi|16758628|       EGNTVMFQHLMQKRKHVQWSLGPLTSSIYDLTEIDSWGEDLSFLELVVSS
gi|4581491|        EGNTVMFQHLMQKRKHVQWTCGPLTSLYDLTEIDSWGEELSFLELVVSS
gi|16161319|       EGNTVMFQHLMQKRRHIQWTYGPLTSILYDLTEIDSWGEELSFLELVVSS 310        320        330        340        350
                   ....|....|....|....|....|....|....|....|....|....|
NOV18 AC073079_C   DKREARQILEQTPVKELVSFKWNKYGRPYFQILAALYLLYMICFTTCCVY
gi|9789941|        DKREARQILEQTPVKEPVSFKWNKYGRPYFQILAALYLLYMICFTTCCVY
gi|9186904|        KKIEARQILEQTPVKELVSLKWKKYGQPYFQLLGMLYISYMICFTTCCVY
gi|16758628|       KKKEARQILEQTPVKELVSLKWKKYGQPYFQLLGMLYIFYMICFTTCCVY
gi|4581491|        KKREARQILEQTPVKELVSFKWKKYGRPYFQVLASLYILYMICFTTCCIY
gi|16161319|       DKREARQILEQTPVKELVSFKWNKYGRPYFQILAALYLLYMICFTTCCVY 360        370        380        390        400
                   ....|....|....|....|....|....|....|....|....|....|
NOV18 AC073079_C   RPLKFRGGNRTHSRDITILQQKLLQEAYETREDIIRLVGELVSIVGAVII
gi|9789941|        RPLKFRGGNRTHSRDITILQQKLLQEAYETREDIIRLVGELVSIVGAVII
gi|9186904|        RPLKFRDANRTHVRDNTVLEQKPLQEAYVTYQDKVRLVGELVTVIGAVVI
gi|16758628|       RPLKFRDANRTHVRDNTVLEQKPLQEAYVTYQDKVRLVGELVTVIGAVVI
gi|4581491|        RPLKLRDDNRTDPRDITILQQKLLQEAYVTHQDNIRLVGELVTVIGAVII
gi|16161319|       RPLKFRGGNRTHSRDITILQQKLLQEAYETREDIIRLVGELVSIVGAVII 410        420        430        440        450
                   ....|....|....|....|....|....|....|....|....|....|
NOV18 AC073079_C   LLLEIPDIFRVGASRYFGKTILGGPFHVIMITYASLVLVTMVMRLTNTNG
gi|9789941|        LLLEIPDIFRVGASRYFGKTILGGPFHVIIITYASLVLVTMVMRLTNTNG
gi|9186904|        LLIEIPDIFRVGASRYFGHTVLGGPFHVIIITYASLVLLIMVMRLTSMNG
gi|16758628|       LLIEIPDIFRVGASRYFGHTVLGGPFHVIIITYASLVLLIMVMRLTSMNG
gi|4581491|        LLLEIPDIFRVGASRYFGQTILGGPFHVIIITYASLVLLTMVMRLTNMNG
gi|16161319|       LLLEIPDIFRVGASRYFGKTILGGPFHVIIITYASLVLVTMVMRLTNTNG 460        470        480        490        500
                   ....|....|....|....|....|....|....|....|....|....|
NOV18 AC073079_C   EVVPMSFALVLGWCSVMYFTRGFQMLGPFTIMIQKMIFGDLMRFCWLMAV
gi|9789941|        EVVPMSFALVLGWCSVMYFTRGFQMLGPFTIMIQKMIFGDLMRFCWLMAV
gi|9186904|        EVVPISMALVLGWCSVMYFSRGFQMLGPFTIMIQKMIFGDLLRFCRLMAM
gi|16758628|       EVVPISMALVLGWCSVMYFSRGFQMLGPFTIMIQKMIFGDLLRFCWLMAM
gi|4581491|        EVVPLSFALVLGWCSVMYFARGFQMLGPFTIMIQKMIFGDLMRFCWLMAV
gi|16161319|       EVVPMSFALVLGWCSVMYFTRGFQMLGPFTIMIQKMIFGDLMRFCWLMAV 510        520        530        540        550
                   ....|....|....|....|....|....|....|....|....|....|
NOV18 AC073079_C   VILGFASAFYIIFQTEDPTSLGQFYDYPMALFTTFELFLTVIDAPANYDV
gi|9789941|        VILGFASAFYIIFQTEDPTSLGQFYDYPMALFSTFELFLTVIDAPANYNV
gi|9186904|        VILGFASAFYIIFQTEDPESLGEFSDYPTAMFSTFELFLTIIDGPANYSV
gi|16758628|       VILGFASAFYIIFQTEDPESLGEFSDYPTAMFSTFELFLTIIDGPANYSV
gi|4581491|        VILGFASAFHITFQTEDPNLGEFSDYPTALFSTFELFLTIIDGPANYSV
gi|16161319|       VILGFASAFYIIFQTEDPTSLGQFYDYPMALFTTFELFLTVIDAPANYDV 560        570        580        590        600
                   ....|....|....|....|....|....|....|....|....|....|
NOV18 AC073079_C   DLPFMFSIVNFAFAIIATLLMLNLFIAMMGDTHWRVAQERDELWRAQVVA
gi|9789941|        DLPFMYSITYAAFAIIATLLMLNLFIAMMGDTHWRVAHERDELWRAQVVA
gi|9186904|        DLPFMYHETYFAFAIIATLLMLNLFIAMMGDTHWRVAQERDELWRAQVVA
gi|16758628|       DLPFMYHETYFAFAIIATLLMLNLFIAMMGDTHWRVAQERDELWRAQVVA
gi|4581491|        DLPFMYCITYAAFAIIATLLMLNLFIAMMGDTHWRVAQERDELWRAQVVA
gi|16161319|       DLPFMFSIVNFAFAIIATLLMLNLFIAMMGDTHWRVAQERDELWRAQVVA 610        620        630        640        650
                   ....|....|....|....|....|....|....|....|....|....|
NOV18 AC073079_C   TTVMLERKLPRCLWPRSGICGCEFGLGDRWFLRVENHNDQNPLRVLRYVE
gi|9789941|        TTVMLERKLPRCLWPRSGICGCEFGLGDRWFLRVENHNDQNPLRVLRYVE
gi|9186904|        TTVMLERKMPRFLWPRSGICGCEYGLGDRWFLRVEHHQEQNPYRVLRYVE
gi|16758628|       TTVMLERKMPRFLWPRSGICGCEYGLGDRWFLRVEHHQEQNPYRVLRYVE
gi|4581491|        TTVMLERKMPRFLWPRSGICGCEYEYGLGDRWFLRVENHDQNPLRVLRYVE
gi|16161319|       TTVMLERKLPRCLWPRSGICGCEFGLGDRWFLRVENHNDQNPLRVLRYVE
```

TABLE 18D-continued

ClustalW Analysis of NOV18

```
                      660        670        680        690        700
                 ....|....|....|....|....|....|....|....|....|....|
NOV18 AC073079_C VFKNSDKEDDQEHPSEKQPSGAESGTLARASLALPTSSLSRTASQSS-SH
gi|9789941|      VFKNSDKEDDQEHPSEKQPSGAESGTLARASLALPTSSLSRTASQSS-SH
gi|9186904|      AFKSSDKEEVQEQLSEKQPSGTERGTLARGSVVLQTPPLSRTTSLSSNSH
gi|16758628|     AFKSSDKEEVQEQLSEKQPSGTERGTLARGSVVLQTPPLSRTTSLSSNSH
gi|4581491|      AFKCSDKEDGQEQLSEKRPSTVESGMLSRASVAFQTPSLSRTTSQSSNSH
gi|16161319|     VFKNSDKEDDQEHPSEKQPSGAESGTLARASLALPTSSLSRTASQSS-SH 710        720        730
                 ....|....|....|....|....|....|.
NOV18 AC073079_C RGWEILRQNTLGHLNLGLNLSEGDGEEVYHR
gi|9789941|      RGWEILRQNTLGHLNLGLNLSEGDGEEVYHR
gi|9186904|      RGWEILRRNTLGHLNLGQDLGEGDGEEIYHR
gi|16758628|     RGWEILRRNTLGHLNLGQDLGEGDGEEIYHR
gi|4581491|      RGWEILRRNTLGHLNLGLDLGEGDGEEVYHR
gi|16161319|     RGWEILRQNTLGHLNLGLNLSEGDGEEVYHR
```

Other BLAST results include sequences from the Patp database, which is a proprietary database that contains sequences published in patents and patent publications. Patp results include those listed in Table 18E.

TABLE 18E

Patp BLASTP Analysis for NOV18

| Sequences producing High-scoring Segment Pairs | Protein/Organism | Length (aa) | Identity (%) | Positive (%) | E Value |
|---|---|---|---|---|---|
| patp: AAU00412 | Human calcium ion channel protein VANILREP5 - *Homo sapiens* | 725 | 544/725 (75%) | 605/725 (83%) | 4.0e-287 |
| patp: AAG63210 | Amino acid sequence of novel human gene hCCh4 - *Homo sapiens* | 725 | 544/725 (75%) | 605/725 (83%) | 4.0e-287 |
| patp: AAB31595 | Amino acid sequence of a human calcium-transport protein - *Homo sapiens* | 725 | 543/725 (74%) | 603/725 (83%) | 2.2e-286 |
| patp: AAB31596 | Amino acid sequence of a rat calcium-transport protein - Rattus sp | 727 | 539/722 (74%) | 605/722 (83%) | 1.7e-281 |
| patp: AAU00413 | Human calcium ion channel protein VANILREP5 splice variant #1 - *Homo sapiens* | 732 | 529/683 (77%) | 584/683 (85%) | 2.7e-281 |

The presence of identifiable domains in the protein disclosed herein was determined by searches versus domain databases such as Pfam, PROSITE, ProDom, Blocks or Prints and then identified by the Interpro domain accession number. Table 18F lists the domain description from DOMAIN analysis results against NOV18.

TABLE 18F

Domain Analysis of NOV18

| Pfam analysis PSSMs producing significant alignments: | Score (bits) | E value |
|---|---|---|
| gnl\|Pfam\|pfam00520 ion_trans, Ion transport protein. This family contains Sodium, . . . | 61.2 | 2e-10 |
| gnl\|Pfam\|pfam00023 ank, Ank repeat. Ankyrin repeats generally consist of a beta, . . . | 40.0 | 5e-04 |
| gnl\|Pfam\|pfam00023 ank, Ank repeat. Ankyrin repeats generally consist of a beta, . . . | 38.9 | 0.001 |

TABLE 18F-continued

Domain Analysis of NOV18 gnl|Pfam|pfam01961 DUF110, Integral membrane protein DUF110. This archaebacterial . . .    3.66    0.005 gnl|Pfam|pfam00520, ion_trans, Ion transport protein. This family contains Sodium, Potassium, Calcium ion channels. This family is 6 transmembrane helices in which the last two helices flank a loop which determines ion selectivity. In some subfamilies (e.g. Na channels) the domain is repeated four times, whereas in others (e.g. K channels) the protein forms as a tetramer in the membrane. A bacterial structure of the protein is known for the last two helices but is not the Pfam family due to it lacking the first four helices
CD-Length = 191 residues, 87.4% aligned
Score = 61.2 bits (147), Expect = 2e-10

```
NOV18:  416 YFGKTILGGPFHVIMITYASLVLVTMVMRLTNTNGEVVPMSFALVLGWCSVMYFTRGFQM  475  (SEQ ID NO:275)
                |   |  |++++      |+ +++ |+         |   +|   ++    |    +
Sbjct:   25 GFKLKYLRSPNNILDFLIVLPSLIDLILFLSG------GGSVLRLLRLLRLLRLLRREG   78  (SEQ ID NO:276)

NOV18:  476 LGPFTIMIQKMIFUDLMRFCWLMAVVILGFASAFYIIFQTEDPTSLGQ---------FYD  526
                |     + + +   |+     |+ +++  ||        +|    |                 |
Sbjct:   79 LRTLLQSLORSL-KSLLNLLLLLLLLLFIFAIIGVQLFGGEFNKCCDGVNPINGNSNFDS  137

NOV18:  527 YPMALFTTFELFLTVIDAPANYDVDLPFMFSIVNF                            561
                +  | +   |        |        |      +    + |
Sbjct:  138 FGEAFYWLFRTLTTEGWGDIMPDTLDAPVLGKIFF                            172

NOV18:  562 -AFAIIATLLMLNLFIANM                                            579
                | |+   ||+|||||++
Sbjct:  173 VIFIILGGLLLLNLFIAVI                                            191
``` gnl|Pfam|pfam00023, ank, Ank repeat. Ankyrin repeats generally consist of a beta, alpha, alpha, beta order of secondary structures. The repeats associate to form a higher order structure.
CD-Length = 33 residues, 93.9% aligned
Score = 40.0 bits (92), Expect = 5e-04

```
NOV18:  164 GEHPLSFAACVNSEEIVRLLIEHGADIRAQD                                194  (SEQ ID NO:277)
                |  ||  ||        |+|+||+|  |||+  |+|
Sbjct:    2 GNTPLHLAARNGHLEVVKLLLEAGADVNARD                                 32  (SEQ ID NO:278)
``` gnl|Pfam|pfam00023, ank, Ank repeat. Ankyrin repeats generally consist of a beta, alpha, alpha, beta order of secondary structures. The repeats associate to form a higher order structure.
CD-Length = 33 residues, 90.9% aligned
Score = 38.9 bits (89), Expect = 0.001

```
NOV18:  118 GQTALHIAVVNQNVNLVRALLTRRASVSAR                                 147  (SEQ ID NO:279)
                |   |  ||+|    |  ++ +|+  ||       |   |+||
Sbjct:    2 GNTPLHLAARNGHLEVVKLLLEAGADVNAR                                  31  (SEQ ID NO:280)
``` gnl|Pfam|pfam01961, DUF110, Integral membrane protein DUF110. This archaebacterial protein family has no known function. Some members of this family are annotated as FlaJ, however we can find no supporting evidence for this annotation.
CD-Length = 541 residues, only 13.5% aligned
Score = 36.6 bits (83), Expect = 0.005

```
NOV18:  513 FQTEDPTSLGQFYDYPMALFTTFELFLT-VIDAPANYDVDLPFMFSIVNFAFAIIATLLM  571  (SEQ ID NO:281)
                |       || + +  ++ |+   ||+ ||   |+    +    ||+| ||    ++ ||+
Sbjct:  159 FYERALESLDIYKEIYVSAFVSIPLFVVFVILVPSLLGANFVANFTISLFAIPALSLLLV  218  (SEQ ID NO:282)

NOV18:  572 LNLFIANNGDTHW                                                  584
                | + + +  |   |
Sbjct:  219 LLIKLRVPIDPIW                                                  231
```

The disclosed NOV18 nucleic acid encoding a calcium transporter-like protein includes the nucleic acid whose sequence is provided in Table 18A, or a fragment thereof. The invention also includes a mutant or variant nucleic acid any of whose bases may be changed from the corresponding base shown in Table 18A while still encoding a protein that maintains its calcium transporter-like activities and physiological functions, or a fragment of such a nucleic acid. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 3% of the bases may be so changed.

The disclosed NOV18 protein of the invention includes the calcium transporter-like protein whose sequence is provided in Table 18B. The invention also includes a mutant or variant protein any of whose residues may be changed from the corresponding residue shown in Table 18B while still encoding a protein that maintains its calcium transporter-like activities and physiological functions, or a functional fragment thereof. In the mutant or variant protein, up to about 4% of the residues may be so changed.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle. Additional SNP variants of NOV18 are disclosed in Examples.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV18 protein has multiple hydrophilic regions, each of which can be used as an immunogen. In one embodiment, a contemplated NOV18 epitope is from about amino acids 1 to 84. In another embodiment, a contemplated NOV18 epitope is from about amino acids 145 to 165. In other specific embodiments, contemplated NOV18 epitopes are from about amino acids 181 to 193, from about amino acids 216 to 248, from about amino acids 255 to 287, from about amino acids 294 to 326, from about amino acids 350 to 386, from about amino acids 516 to 526, from about amino acids 581 to 600, from about amino acids 608 to 677, and from about amino acids 686 to 730. These novel proteins can be used in assay systems for functional analysis of various human disorders, which will help in understanding of pathology of the disease and development of new drug targets for various disorders.

The Calcium transporter disclosed in this invention is expressed in at least the following tissues: adipose, skeletal muscle, liver, kidney, and brain. This information was derived from expression data from animal studies done by Curagen. Restriction fragments unique to the coding sequence of the protein of the invention were discovered in cDNA derived from metabolic tissues in rat models of obesity, hyperlipidemia, Type II diabetes and the Metabolic Syndrome X. Additional disease indications and tissue expression for NOV18 and NOV18 variants, if available, are presented in the Examples.

The protein similarity information, expression pattern, and map location for the Calcium transporter-like protein and nucleic acid disclosed herein suggest that this Calcium transporter may have important structural and/or physiological functions characteristic of the Calcium transporter family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from: Dyslipidemia, insulin resistance, obesity, hypertension and other conditions associated with the Metabolic Syndrome X and disorders of the like.

NOV19

NOV19 includes two novel Carbonic Anhydrase-related Protein-like proteins. The disclosed sequences have been named NOV19a and NOV19b. Unless specifically addressed as NOV19a or NOV19b, any reference to NOV19 is assumed to encompass all variants.

A disclosed NOV19a nucleic acid of 847 nucleotides (also referred to as MBNM_004056_da2 or CG50157-01) (SEQ ID NO:45) encoding a novel Carbonic Anhydrase-related Protein-like protein is shown in Table 19A. An open reading frame was identified beginning with an ATG initiation codon at nucleotides 1–3 and ending with a TAG codon at nucleotides 775–777. Putative untranslated regions upstream from the initiation codon and downstream from the termination codon are underlined and the start and stop codons are in bold in Table 19A.

TABLE 19A

NOV19a nucleotide sequence (SEQ ID NO:45)

ATGGCGGACCTGAGCTTCATCGAAGATACCGTCGCCTTCCCCGAGAAGGAAGAGGATGAGGAGGAAGAAGAGGAGG

TGTGGAGTGGGGCTACGAGGAAGGTGTTGAGTGGGGTCTGGTCTTTCCTGATGCTAATGGGGAATACCAGTCTCCTA

TTAACCTAAACTCAAGAGAGGCTAGGTATGACCCCTCGCTGTTGGATGTCCGCCTCTCCCCAAATTATGTGGTGTGC

CGAGACTGTGAAGTCACCAATGATGGACACACCATTCAGGTTATCCTGAAGTCAAAATCAGTTCTTTCGGGAGGACC

ATTGCCTCAACGGCATGAATTTGAACTGTACGAAGTGAGATTTCACTGGGGAAGAGAAAACCAGCGTGGTTCTGAGC

ACACGGTTAATTTCAAAGCTTTTCCCATGGAGATAGGAAAGGAACATGTTGGCTTGAAGGCTGTGACTGAAATCCTC

CAAGATATTCAGTATAAGGGGAAGTCCAAAACAATACCTTGCTTTAATCCTAACACTTTATTACCAGACCCTCTGCT

GCGGGATTACTGGGTGTATGAAGGCTCTCTCACCATCCCACCTTGCAGTGAAGGTGTCACCTGGATATTATTCCGAT

ACCCTTTAACTATATCCCAGCTACAGATAGAAGAATTTCGAAGGCTGACGACACATGTTAAGGCGGCAGAACTTGTG

TABLE 19A-continued

NOV19a nucleotide sequence (SEQ ID NO:45)

GAAGGCTGTGATGGGATTTTGGGAGACAACTTTCGGCCCACTCAGCCTCTTAGTGACAGAGTCATTAGAGCTGCATT

TCAGTAGCCAAAGAGGACAGGAACAAGTCTGTCTTCATGAGGGAGGAAGACAATGGTCTATAATGCCCTTGGATAAG

The Carbonic anhydrase-related protein-like NOV19 disclosed in this invention maps to chromosome 8.

A disclosed NOV9a polypeptide (SEQ ID NO:46) encoded by SEQ ID NO:45 has 258 amino acid residues and is presented in Table 19B using the one-letter code. The SignalP, Psort and Hydropathy results predict that NOV19a is likely to be localized in the cytoplasm with a certainty of 0.4500. In an alternative embodiment, NOV19a is likely to be localized to the microbody (peroxisome) with a certainty of 0.2104, or to the mitochondrial matrix space with a certainty of 0.1000, or to the lysosome lumen with a certainty of 0.1000.

the protein of the invention was found to have 140 of 144 amino acid residues (97%) identical to, and 141 of 144 amino acid residues (97%) similar to, the 290 amino acid residue ptnr:SWISSPROT-ACC:P35219 protein from *Homo sapiens* (CARBONIC ANHYDRASE-RELATED PROTEIN (CARP) (CA-VIII)).

In an alternative embodiment, a NOV19 variant is a NOV19b nucleic acid of 847 nucleotides (also referred to as CG50157-02) (SEQ ID NO:47) encoding a novel Carbonic Anhydrase-Related Protein-like protein shown in Table 19C.

TABLE 19B

NOV19a protein sequence (SEQ ID NO:46)

MADLSFIEDTVAFPEKEEDEEEEEEGVEWGYEEGVEWGLVFPDANGEYQSPINLNSREARYDPSLLDVRL

SPNYVVCRDCEVTNDGHTIQVILKSKSVLSGGPLPQGHEFELYEVRFNWGRENQRGSEHTVNFKAFPMEI

GKEHVGLKAVTEILQDIQYKGKSKTIPCFNPNTLLPDPLLRDYWVYEGSLTIPPCSEGVTWILFRYPLTI

SQLQIEEFRRLRTHVKGAELVEGCDGILGDNFRPTQPLSDRVIRAAFQ

In a search of sequence databases, it was found, for example, that the nucleic acid sequence of NOV19a has 432 of 432 bases (100%) identical to a gb:GENBANK-ID:HUMCARP|acc:L04656.1 Mrna from *Homo sapiens* (*Homo sapiens* carbonic anhydrase-related protein VIII (CA8) Mrna, partial cds). The full amino acid sequence of An open reading frame was identified beginning at nucleotides 1–3 and ending at nucleotides 775–777. The start and stop codons of the open reading frame are highlighted in bold type. Putative untranslated regions (underlined) are found upstream from the initiation codon and downstream from the termination codon.

TABLE 19C

NOV19b nucleotide sequence (SEQ ID NO:47)

ATGGCCGACCTGAGCTTCATCGAAGATACCGTCGCCTTCCCCGAGAAGGAAGAGGATGAG

GACGAAGAAGAGGAGGGTGTGGAGTGGGGCTACGAGGAAGGTGTTGAGTGGGGTCTGGTG

TTTCCTGATGCTAATGGGGAATACCAGTCTCCTATTAACCTAAACTCAAGAGAGGCTAGG

TATGACCCCTCGCTGTTGGATGTCCGCCTCTCCCCAAATTATGTGGTGTGCCGAGACTGT

GAAGTCACCAATGATGGACACACCATTCACGTTATCCTGAAGTCAAAATCAGTTCTTTCG

GGAGGACCATTGCCTCAAGGGCATGAATTTGAACTGTACGAAGTGAGATTTCACTGGGGA

AGAGAAAACCAGCGTGGTTCTGAGCACACGGTTAATTTCAAAGCTTTTCCCATGGAGATA

GGAAAGGAACATGTTGGCTTGAAGGCTGTGACTGAAATCCTCCAAGATATTCAGTATAAG

GGGAAGTCCAAAACAATACCTTGCTTTAATCCTAACACTTTATTACCAGACCCTCTGCTG

CGGGATTACTGGGTGTATGAACGCTCTCTCACCATCCCACCTTGCAGTGAAGGTGTCACC

TGGATATTATTCCGATACCCTTTAACTATATCCCAGCTACAGATAGAAGAATTTCGAAGG

CTGAGGACACATGTTAAGGGGGCAGAACTTGTGGAAGGCTGTGATGGGATTTTGGGAGAC

TABLE 19C-continued

NOV19b nucleotide sequence (SEQ ID NO:47)

AACTTTCGGCCCACTCAGCCTCTTAGTGACAGAGTCATTAGAGCTGCATTTCAGTAGCCA

AAGAGGACAGGAACAAGTCTGTCTTCATGAGGGAGGAAGACAATGGTCTATAATGCCCTT

GGATAAG

The encoded protein of NOV19b (SEQ ID NO:48) having 258 amino acid residues is presented in Table 19D using the one-letter code. The PSORT, SignalP and hydropathy results predict that NOV19b has no signal peptide and is likely to be localized in the cytoplasm with a certainty of 0.4500 predicted by PSORT. In an alternative embodiment, NOV19b is likely to be localized to the microbody (peroxisome) with a certainty of 0.2104, or to the mitochondrial matrix space with a certainty of 0.1000, or to the lysosome lumen with a certainty of 0.1000. The hydropathy profile is characteristic of the Carbonic Anhydrase-Related Protein family.

In a search of sequence databases, it was found, for example, that the nucleic acid sequence of NOV19b has 377 of 422 bases (89%) identical to a gb:GENBANK-ID:MMCARP|acc:X61397.1 Mrna from *Mus musculus* (Mouse Mrna for carbonic anhydrase-related polypeptide). The full amino acid sequence of the protein of NOV19b was found to have 140 of 144 amino acid residues (97%) identical to, and 141 of 144 amino acid residues (97%) similar to, the 290 amino acid residue ptnr:SWISSPROT-ACC:P35219 protein from *Homo sapiens* (CARBONIC ANHYDRASE-RELATED PROTEIN (CARP) (CA-VIII)).

In a search of public sequence databases, NOV19 was found to have homology to the amino acid sequences shown in the BLASTP data listed in Table 19E.

TABLE 19D

NOV19b protein sequence (SEQ ID NO:48)

MADLSFIEDTVAFPEKEEDEEEEEGVEWGYEEGVEWGLVFPDANGEYQSPINLNSREAR

YDPSLLDVRLSPNYVVCRDCEVTNDGHTIQVILKSKSVLSGGPLPQGHEFELYEVRFHWG

RENQRGSEHTVNFKAFPMETGKEHVGLKAVTEILQDIQYKGKSKTIPCFNPNTLLPDPLL

RDYWVYEGSLTIPPCSEGVTWILFRYPLTISQLQIEEFRRLRTHVKGAELVEGCDGILGD

NFRPTQPLSDRVIRAAFQ

TABLE 19E

BLASTP results for NOV19

| Gene Index/ Identifier | Protein/Organism | Length (aa) | Identity (%) | Positives (%) | Expect |
|---|---|---|---|---|---|
| gi\|5148944\|ref\| NP_004047.2\| (NM_004056) | carbonic anhydrase VIII; CA-related protein [*Homo sapiens*] | 290 | 257/290 (88%) | 258/290 (88%) | e-142 |
| gi\|461681\| sp\|P35219\| CAH8_HUMAN | CARBONIC ANHYDRASE-RELATED PROTEIN (CARP) (CA-VIII) | 290 | 258/290 (88%) | 258/290 (88%) | e-136 |
| gi\|5069431\| gb\|AAA35653.2\| (L04656) | carbonic anhydrase-related protein VIII [*Homo sapiens*] | 289 | 257/289 (88%) | 257/289 (88%) | e-135 |
| gi\|14789722\| gb\|AAH10773.1\| AAH10773 (BC010773) | Similar to carbonic anhydrase VIII [*Mus musculus*] | 291 | 251/291 (86%) | 256/291 (87%) | e-133 |
| gi\|5915864\| sp\|P28651\| CAH8_MOUSE | CARBONIC ANHYDRASE-RELATED PROTEIN (CARP) (CA-VIII) | 291 | 250/291 (85%) | 255/291 (86%) | e-132 |

A multiple sequence alignment is shown in Table 19F, with the proteins of the invention being shown on lines one and two in a ClustalW analysis comparing the protein of the invention with related protein sequences shown in Table 19E. Note that NOV 19b represents a splice form of Carbonic Anhydrase-Related Protein as indicated in positions 140 to 171.

TABLE 19F

ClustalW Analysis of NOV19

1) NOV19a MBNM_004056_da2 (SEQ ID NO:46)
2) NOV19b CG50157-02 (SEQ ID NO:48)
3) gi|5148944| (SEQ ID NO:143)
4) gi|461681| (SEQ ID NO:144)
5) gi|5069431| (SEQ ID NO:145)
6) gi|14789722| (SEQ ID NO:146)
7) gi|5915864| (SEQ ID NO:147)

```
                                   10        20        30        40        50
                            ....|....|....|....|....|....|....|....|....|....|
NOV19a MBNM_004056_da2      MADLSFIEDTVAFPEKEEDEEEEEE-GVEWGYEEGVEWGLVFPDANGEYQ
NOV19b CG50157-02           MADLSFIEDTVAFPEKEEDEEEEEE-GVEWGYEEGVEWGLVFPDANGEYQ
gi|5148944|                 MADLSFIEDTVAFPEKEEDEEEEEK-GVEWGYEEGVEWGLVFPDANGEYQ
gi|461681|                  MADLSFIEDTVAFPEKEEDEEEEEE-GVEWGYEEGVEWGLVFPDANGEYQ
gi|5069431|                 -ADLSFIEDTVAFPEKEEDEEEEEE-GVEWGYEEGVEWGLVFPDANGEYQ
gi|14789722|                MADLSFIEDAVAFPEKEEDEEEEEE GVEWGYEEGVEWGLVFPDANGEYQ
gi|5915864|                 MADLSFIEDAVAFPEKEEDEEEEEEGVEWGYEEGVEWGLVFPDANGEYQ 60        70        80        90       100
                            ....|....|....|....|....|....|....|....|....|....|
NOV19a MBNM_004056_da2      SPINLASREARYDPSLLDVRLSPNYVVCRDCEVTNDGHTIQVILKSKSVL
NOV19b CG50157-02           SPINLASREARYDPSLLDVRLSPNYVVCRDCEVTNDGHTIQVILKSKSVL
gi|5148944|                 SPINLASREARYDPSLLDVRLSPNYVVCRDCEVTNDGHTIQVILKSKSVL
gi|461681|                  SPINLASREARYDPSLLDVRLSPNYVVCRDCEVTNDGHTIQVILKSKSVL
gi|5069431|                 SPINLASREARYDPSLLDVRLSPNYVVCRDCEVTNDGHTIQVILKSKSVL
gi|14789722|                SPINLASREARYDPSLLDVRLSPNYVVCRDCEVTNDGHTIQVILKSKSVL
gi|5915864|                 SPINLASREARYDPSLLDVRLSPNYVVCRDCEVTNDGHTIQVILKSKSVL 110       120       130       140       150
                            ....|....|....|....|....|....|....|....|....|....|
NOV19a MBNM_004056_da2      SGGPLPQGHEFELYEVRFHWGRENQRGSEHTVMFKAFPME----------
NOV19b CG50157-02           SGGPLPQGHEFELYEVRFHWGRENQRGSEHTVMFKAFPME----------
gi|5148944|                 SGGPLPQGHEFELYEVRFHWGRENQRGSEHTVMFKAFPMELHLIHWNSTL
gi|461681|                  SGGPLPQGHEFELYEVRFHWGRENQRGSEHTVMFKAFPMELHLIHWNSTL
gi|5069431|                 SGGPLPQGHEFELYEVRFHWGRENQRGSEHTVMFKAFPMELHLIHWNSTL
gi|14789722|                SGGPLPQGQEFELYEVRFHWGRENQRGSEHTVMFKAFPMELHLIHWNSTL
gi|5915864|                 SGGPLPQGQEFELYEVRFHWGRENQRGSEHTVMFKAFPMELHLIHWNSTL 160       170       180       190       200
                            ....|....|....|....|....|....|....|....|....|....|
NOV19a MBNM_004056_da2      ----------------------IGKEHVGLKAVTEILQDIQYKGKSKTIP
NOV19b CG50157-02           ----------------------IGKEHVGLKAVTEILQDIQYKGKSKTIP
gi|5148944|                 FGSIDEAVGKPHGIAIIALFVQIGKEHVGLKAVTEILQDIQYKGKSKTIP
gi|461681|                  FGSIDEAVGKPHGIAIIALFVQIGKEHVGLKAVTEILQDIQYKGKSKTIP
gi|5069431|                 FGSIDEAVGKPHGIAIIALFVQIGKEHVGLKAVTEILQDIQYKGKSKTIP
gi|14789722|                FGSIDEAVGKPHGIAIIALFVQIGKEHVGLKAVTEILQDIQYKGKSKTIP
gi|5915864|                 FGSIDEAVGKPHGIAIIALFVQIGKEHVGLKAVTEILQDIQYKGKSKTIP 210       220       230       240       250
                            ....|....|....|....|....|....|....|....|....|....|
NOV19a MBNM_004056_da2      CFNPNTLLPDPLLRDYWVYEGSLTIPPCSEGVTWILFRYPLTISQLQIEE
NOV19b CG50157-02           CFNPNTLLPDPLLRDYWVYEGSLTIPPCSEGVTWILFRYPLTISQLQIEE
gi|5148944|                 CFNPNTLLPDPLLRDYWVYEGSLTIPPCSEGVTWILFRYPLTISQLQIEE
gi|461681|                  CFNPNTLLPDPLLRDYWVYEGSLTIPPCSEGVTWILFRYPLTISQLQIEE
gi|5069431|                 CFNPNTLLPDPLLRDYWVYEGSLTIPPCSEGVTWILFRYPLTISQLQIEE
gi|14789722|                CFNPNTLLPDPLLRDYWVYEGSLTIPPCSEGVTWILFRYPLTISQMQIEE
gi|5915864|                 CFNPNTLLPDPLLRDYWVYEGSLTIPPCSEGVTWILFRYPLTISQMQIEE 260       270       280       290
                            ....|....|....|....|....|....|....|....|....|.
NOV19a MBNM_004056_da2      FRRLRTHVKGAELVEGCDGILGDNFRPTQPLSDRVIRAAFQ
NOV19b CG50157-02           FRRLRTHVKGAELVEGCDGILGDNFRPTQPLSDRVIRAAFQ
gi|5148944|                 FRRLRTHVKGAELVEGCDGILGDNFRPTQPLSDRVIRAAFQ
gi|461681|                  FRRLRTHVKGAELVEGCDGILGDNFRPTQPLSDRVIRAAFQ
gi|5069431|                 FRRLRTHVKGAELVEGCDGILGDNFRPTQPLSDRVIRAAFQ
gi|14789722|                FRRLRTHVKGAELVEGCDGILGDNFRPTQPLSDRVIRAAFQ
gi|5915864|                 FRRLRTHVKGVELVEGCDGILGDNFRPTQPLSDRVIRAAFQ
```

Other BLAST results include sequences from the Patp database, which is a proprietary database that contains sequences published in patents and patent publications. Patp results include those listed in Table 19G.

Eukaryotic-type carbonic anhydrase, IPR001148 and Carbonic anhydrases (EC 4.2.1.1) (CA) in general are zinc metalloenzymes which catalyze the reversible hydration of carbon dioxide. Eight enzymatic and evolutionary related

TABLE 19G

Patp BLASTP Analysis for NOV19

| Sequences producing High-scoring Segment Pairs | Protein/Organism | Length (aa) | Identity (%) | Positive (%) | E Value |
|---|---|---|---|---|---|
| patp: AAB59593 | Human carbonic anhydrase isoform #6 - *Homo sapiens* | 261 | 51/121 (42%) | 71/121 (58%) | 3.6e−44 |
| patp: AAW75702 | Carbonic anhydrase II protein - *Homo sapiens* | 260 | 49/121 (40%) | 76/121 (62%) | 4.5e−40 |
| patp: AAB53405 | Human colon cancer antigen protein sequence clone no: 945 - *Homo sapiens* | 294 | 49/121 (40%) | 76/121 (62%) | 4.5e−40 |
| patp: AAB59589 | Human carbonic anhydrase isoform #2 - *Homo sapiens* | 259 | 49/121 (40%) | 76/121 (62%) | 4.5e−40 |
| patp: AAB59588 | Human carbonic anhydrase isoform #1 - *Homo sapiens* | 260 | 50/120 (41%) | 73/120 (60%) | 1.9e−39 |

The presence of identifiable domains in the protein disclosed herein was determined by searches versus domain databases such as Pfam, PROSITE, ProDom, Blocks or Prints and then identified by the Interpro domain accession number. The results indicate that NOV 19a contains the following protein domains (as defined by Interpro) at the indicated positions: domain name carb_anhydrase at amino acid positions 24 to 139 and at amino acid positions 140 to 257. Significant domains of NOV19b are summarized in Table 19H.

forms of carbonic anhydrase are currently known to exist in vertebrates: three cytosolic isozymes (CA-I, CA-II and CA-III); two membrane-bound forms (CA-IV and CA-VII); a mitochondrial form (CA-V); a secreted salivary form (CA-VI); and a yet uncharacterized isozyme. This indicates that the sequence of the invention has properties similar to those of other proteins known to contain this/these domain (s) and similar to the properties of these domains. Table 19I lists the domain description from DOMAIN analysis results against NOV19.

TABLE 19H

Domain Analysis of NOV19b

| Model | Domain | seq-f | seq-t | hmm-f | hmm-t | score | E-value |
|---|---|---|---|---|---|---|---|
| carb_anhydrase | 1/2 | 24 | 139 ... | 1 | 131 [. | 221.3 | 1.4e−62 |
| carb_anhydrase | 2/2 | 140 | 257 ... | 164 | 283 .] | 247.2 | 2.2e−70 |

TABLE 19I

Domain Analysis of NOV19

| Pfam analysis PSSMs producing significant alignments: | Score (bits) | E value |
|---|---|---|
| gnl\|Pfam\|pfam00194 carb_anhydrase, Eukaryotic-type carbonic anyhydrase | 285 | 2e−78 |

```
gnl|Pfam|pfam00194, carb_anhydrase, Eukaryotic-type carbonic anhydrase.
CD-Length = 255 residues, 94.9% aligned
Score = 285 bits (730), Expect = 2e-78

NOV19:    39 LVFPDANGEYQSPINLNSREARYDPSLLDVRLSPNYVVCRDCEVTNDGHTIQVILKS---  95   (SEQ ID NO:283)
             |++|   |+ ||||+ +++||||||   + +|      +  |+||+||++||
Sbjct:    14 LLYPIAGGDRQSPINIQTKKARYDPSLKPLSVSYYAATAK--EITNNGHSVQVEFDDSMD  71   (SEQ ID NO:284)

NOV19:    96 KSVLSGGPLPQGHEFELYEVRFHWGRENQROSEHTVNFKAFPMEI---------------  140
             ||||||||||    + | +  ||||  |+ ||||||+    +|  |+
Sbjct:    72 KSVLSGGPLPA--PYRLKQFHFHWQSSNEHQSEHTVDGVKYPAELHLVHWNSTKYGSYKE  129

NOV19:   141 -----------------GKEHVGLKAVTEILQDIQYKGKSKTIPCFNPNTLLPDLLRDY  183
                              |  |+ ||+ +  ||+|+ ||||   |+|+ |||    ||||
Sbjct:   130 AQKKPDGLAVLGVFVKVGAENPGLQKLVDALQNIKTKGESATFTNFDPSDLLPA--LRDY  187
```

TABLE 19I-continued

Domain Analysis of NOV19

```
NOV19:  184  WVYEGSLTIPPCSEGVTWILFRYPLTISQLQIEEFRRLRTHVKGAELVEGCDGILGDNFR  243
             |  |  ||||  |||+|  ||||+ + |+|+|   |+|+||  |    |+|  | |      + ||+|
Sbjct:  188  WTYPGSLTTPPCTESVTWIVLKEPITVSSEQLEKFRSLLFSVEGEEEVP-----MVDNYR  242

NOV19:  244  PTQPLSDRVIRAA                                               256
             |||||  ||+||+
Sbjct:  243  PTQPLKGRVVRAS                                               255
```

The disclosed NOV19 nucleic acids encoding a Carbonic Anhydrase-related Protein-like proteins include the nucleic acids whose sequences are provided in Table 19A and Table 19C, or a fragment thereof. The invention also includes a mutant or variant nucleic acid any of whose bases may be changed from the corresponding base shown in Table 19A or Table 19C while still encoding a protein that maintains its Carbonic Anhydrase-related Protein-like activities and physiological functions, or a fragment of such a nucleic acids. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 0% of the bases may be so changed of NOV19a and up to about 11% of the bases may be so changed of NOV19b.

The disclosed NOV19 protein of the invention includes the Carbonic Anhydrase-related Protein-like proteins whose sequences are provided in Table 19B and Table 19D. The invention also includes a mutant or variant protein any of whose residues may be changed from the corresponding residue shown in Table 19B or Table 19D while still encoding a protein that maintains its Carbonic Anhydrase-related Protein-like activities and physiological functions, or a functional fragment thereof. In the mutant or variant protein, up to about 3% of the residues may be so changed of NOV19a and up to about 3% of the residues may be so changed of NOV19b.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV19a protein has multiple hydrophilic regions, each of which can be used as an immunogen. In one embodiment, a contemplated NOV19a epitope is from about amino acids 1 to 72. In another embodiment, a contemplated NOV19a epitope is from about amino acids 76 to 89. In other specific embodiments, contemplated NOV19a epitopes are from about amino acids 99 to 142, from about amino acids 146 to 192, and from about amino acids 210 to 258. These novel proteins can be used in assay systems for functional analysis of various human disorders, which will help in understanding of pathology of the disease and development of new drug targets for various disorders. The disclosed NOV19b protein has multiple hydrophilic regions, each of which can be used as an immunogen. In one embodiment, a contemplated NOV19b epitope is from about amino acids 1 to 72. In another embodiment, a contemplated NOV19b epitope is from about amino acids 76 to 89. In other specific embodiments, contemplated NOV19b epitopes are from about amino acids 99 to 142, from about amino acids 146 to 192, and from about amino acids 210 to 258. These novel proteins can be used in assay systems for functional analysis of various human disorders, which will help in understanding of pathology of the disease and development of new drug targets for various disorders.

The Carbonic anhydrase-related Protein disclosed in this invention is expressed in at least the following tissues: Bone Marrow, Brain, Kidney, Liver, Whole Organism. This information was derived by determining the tissue sources of the sequences that were included in the invention including but not limited to SeqCalling sources, Public EST sources, Literature sources, and/or RACE sources. Additional disease indications and tissue expression for NOV19 and NOV19 variants, if available, are presented in the Examples.

The protein similarity information, expression pattern, and map location for the Carbonic Anhydrase-related Protein-like protein and nucleic acid disclosed herein suggest that this Carbonic anhydrase-related Protein may have important structural and/or physiological functions characteristic of the carbonic anhydrase family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from: hemophilia, hypercoagulation, idiopathic thrombocytopenic purpura, autoimmune disease, allergies, immunodeficiencies, transplantation, graft versus host disease, Von Hippel-Lindau (VHL) syndrome, Alzheimer's disease, stroke, tuberous sclerosis, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neuroprotection, diabetes, renal artery stenosis, interstitial nephritis, glomerulonephritis, polycystic kidney disease, systemic lupus erythematosus, renal tubular acidosis, IgA nephropathy, cirrhosis, and other diseases, disorders and conditions of the like.

NOV20

NOV20 includes two novel GABA receptor associated-like proteins. The disclosed sequences have been named NOV20a and NOV20b. Unless specifically addressed as NOV20a or NOV20b, any reference to NOV20 is assumed to encompass all variants.

A disclosed NOV20a nucleic acid of 354 nucleotides (also referred to as AC018946.4_A or CG56872-01) (SEQ ID NO:49) encoding a novel GABA receptor associated-like protein is shown in Table 20A. An open reading frame was identified beginning with an ATG initiation codon at nucleotides 1–3 and ending with a TGA codon at nucleotides 352–354. The start and stop codons are in bold in Table 20A.

The GABA receptor associated-like NOV20 disclosed in this invention maps to chromosome 15.

A disclosed NOV20a polypeptide (SEQ ID NO:50) encoded by SEQ ID NO:49 has 117 amino acid residues and is presented in Table 20B using the one-letter code. The SignalP, Psort and/or Hydropathy results predict that NOV20a has no signal peptide and is likely to be localized in the cytoplasm with a certainty of 0.4500 predicted by PSORT. In an alternative embodiment, NOV20a is likely to be localized to the microbody (peroxisome) with a certainty of 0.2950, or to the mitochondrial matrix space with a certainty of 0.1000, or to the lysosome lumen with a certainty of 0.1000.

TABLE 20B

NOV20a protein sequence (SEQ ID NO:50)

MKFQYKEVHPFEYRKKEGEKIRKKYPDRVPLIVEKAPKARVPDLDRRKYLVPSDLTDGQFYLLIRKRIHL
RPEDALFFFVNNTIPPTSATMGQLYEDSHEEDDFLYVAYSNESVYGK

In a search of sequence databases, it was found, for example, that the nucleic acid sequence of NOV20a has 315 of 354 bases (88%) identical to a gb:GENBANK-ID:AB041648|acc:AB041648.1 Mrna from *Mus musculus* (*Mus musculus* brain cDNA, clone MNCb-0091). The full amino acid sequence of the protein of NOV20a was found to have 109 of 117 amino acid residues (93%) identical to, and 113 of 117 amino acid residues (96%) similar to, the 117 amino acid residue ptnr:SPTREMBL-ACC:Q9JJ97 protein from *Mus musculus* (BRAIN CDNA, CLONE MNCB-0091).

In an alternative embodiment, a NOV20 variant is a NOV20b nucleic acid of 417 nucleotides (also referred to as CG56872-02) (SEQ ID NO:51) encoding a novel GABA Receptor Associated Protein-like protein shown in Table 20C. An open reading frame was identified beginning at nucleotides 26–28 and ending at nucleotides 377–379. The start and stop codons of the open reading frame are highlighted in bold type. Putative untranslated regions (underlined), if any, are found upstream from the initiation codon and downstream from the termination codon.

TABLE 20A

NOV20a nucleotide sequence (SEQ ID NO:49)

ATGAAGTTCCAGTACAAGGAGGTCCATCCCTTTGAGTATCGGAAAAAGGAAGGAGAAAAGATCCCGAAGA
AATATCCGGACAGGGTCCCCTTGATTGTAGAGAAGGCTCCAAAAGCAAGGGTGCCTGATCTGGACAGGAG
GAAGTACCTAGTGCCCTCCGACCTTACCGATGGCCAGTTCTACCTTTTAATCCGGAAGAGAATCCACCTG
AGACCTGAGGACGCCTTATTCTTCTTTGTCAACAACACTATCCCTCCCACTAGTGCTACCATGGGCCAAC
TATATGAGGACAGTCATGACGAAGATGATTTTCTGTATGTGGCCTACAGTAATCAGAGTGTCTATGGGAA
ATGA

TABLE 20C

NOV20b nucleotide sequence (SEQ ID NO:51)

GATCACGGAAGCCCTGTGATTCACCATGAAGTTCCAGTACAAGGAGGTCCATCCCTTTGA

GTATCGGAAAAAGGAAGGAGAAAAGATCCGGAAGAAATATCCGGACAGGGTCCCCTTGAT

TGTAGAGAAGGCTCCAAAAGCAAGGGTGCCTGATCTGGACAGCAGGAAGTACCTAGTGCC

CTCCGACCTTACCGATGGCCAGTTCTACCTTTTAATCCGGAAGAGAATCCACCTGAGACC

TGAGGACGCCTTATTCTTCTTTGTCAACAACACTATCCCTCCCACTAGTGCTACCATGGG

CCAACTATATGAGGACAGTCATGAGGAAGATGATTTTCTGTATGTGGCCTACAGTAATGA

GAGTGTCTATGGGAAATGAGTGGTTGGAAGCCCAGCAGATGGGAAGCACCTGGACTT

The encoded protein of NOV20b (SEQ ID NO:52) having 117 amino acid residues is presented in Table 20D using the one-letter code. The PSORT, SignalP and hydropathy profile for the GABA Receptor Associated Protein-like protein are shown in FIG. 5. The results predict that this sequence has no signal peptide and is likely to be localized intracellularly with a certainty of 0.4500. In an alternative embodiment, NOV20a is likely to be localized to the microbody (peroxisome) with a certainty of 0.2950, or to the mitochondrial matrix space with a certainty of 0.1000, or to the lysosome lumen with a certainty of 0.1000.

TABLE 20D

NOV20b protein sequence (SEQ ID NO:52)

MKFQYKEVHPFEYRKKEGEKIRKKYPDRVPLIVEKAPKARVPDLDRRKYLVPSDLTDGQF

YLLIRKRIHLRPEDALFFFVNNTIPPTSATMGQLYEDSHEEDDFLYVAYSNESVYGK

In a search of sequence databases, it was found, for example, that the nucleic acid sequence of NOV20b has 257 of 347 bases (74%) identical to a gb:GENBANK-ID:AF161586|acc:AF161586.1 Mrna from *Homo sapiens* (*Homo sapiens* GABA-A receptor-associated protein (GABARAP) Mrna, complete cds). The full amino acid sequence of the protein of NOV20b was found to have 96 of 116 amino acid residues (82%) identical to, and 105 of 116 amino acid residues (90%) similar to, the 117 amino acid residue ptnr:SPTREMBL-ACC:O95166 protein from *Homo sapiens* (MM46).

In a search of public sequence databases, NOV20 was found to have homology to the amino acid sequences shown in the BLASTP data listed in Table 20E.

TABLE 20E

| | BLASTP results for NOV20 | | | | |
|---|---|---|---|---|---|
| Gene Index/ Identifier | Protein/Organism | Length (aa) | Identity (%) | Positives (%) | Expect |
| gi|14211879|ref|NP_115957.1| (NM_032568) | GABA-A receptor-associated protein [*Homo sapiens*] | 117 | 117/117 (100%) | 117/117 (100%) | 3e-54 |
| gi|10181206|ref|NP_065615.1| (NM_020590) | GABA (A) receptor-associated protein like 1 [*Mus musculus*] | 117 | 109/117 (93%) | 113/117 (96%) | 3e-49 |
| gi|6005764|ref|NP_009209.1| (NM_007278) | GABA (A) receptor-associated protein [*Homo sapiens*] | 117 | 96/116 (82%) | 105/116 (89%) | 7e-45 |
| gi|12833187|dbj|BAB22426.1| (AK002879) | putative [*Mus musculus*] | 117 | 95/116 (81%) | 105/116 (89%) | 1e-44 |
| gi|7291184|gb|AAF46617.1| (AE003451) | CG1534 gene product [alt 1] [*Drosophila melanogaster*] | 121 | 93/116 (80%) | 105/116 (90%) | 2e-44 |

A multiple sequence alignment is shown in Table 20F, with the proteins of the invention being shown on lines one and two in a ClustalW analysis comparing the protein of the invention with related protein sequences shwon in Table 20E.

The presence of identifiable domains in the protein disclosed herein was determined by searches versus domain databases such as Pfam, PROSITE, ProDom, Blocks or Prints and then identified by the Interpro domain accession number. This indicates that the sequence of the invention has properties similar to those of other proteins known to contain this/these domain(s) and similar to the properties of these domains. Table 20H lists the domain description from DOMAIN analysis results against NOV20.

TABLE 20F

ClustalW Analysis of NOV20

1) NOV20a AC018946.4_A (SEQ ID NO:50)
2) NOV20b CG56872_02 (SEQ ID NO:52)
3) gi|14211879| (SEQ ID NO:148)
4) gi|10181206| (SEQ ID NO:149)
5) gi|6005764| (SEQ ID NO:150)
6) gi|12833187| (SEQ ID NO:151)
7) gi|7291184| (SEQ ID NO:152)

```
                         10        20        30        40        50
                   ....|....|....|....|....|....|....|....|....|....|
NOV20a AC018946.4_A MKFQYKEVHPFEYRKKEGEKIRKKYPDRVPLIVEKAPKARVPDLDRRKYL
NOV20b CG56872-02   MKFQYKEVHPFEYRKKEGEKIRKKYPDRVPLIVEKAPKARVPDLDRRKYL
gi|14211879|        MKFQYKEVHPFEYRKKEGEKIRKKYPDRVPLIVEKAPKARVPDLDRRKYL
gi|10181206|        MKFQYKEVHPFEYRKKEGEKIRKKYPDRVPVIVEKAPKARVPDLDRRKYL
gi|6005764|         MKFVYKEHPFEKRRSEGEKIRKKYPDRVPVIVEKAPKARIGDLDKKKYL
gi|12833187|        MKFVYKEEHPFDKRRSEGEKIRKKYPDRVPVIVEKAPKARIGDLDKKKYL
gi|7291184|         MKFQYKBEHAFEKRRAEGDKIRRKYPDRVPVIVEKAPKARIGDLDKKKYL 60        70        80        90       100
                   ....|....|....|....|....|....|....|....|....|....|
NOV20a AC018946.4_A VPSDLTDGQFYLLIRKRIHLRPEDALFFFVNNTIPPTSATMGQLYEDSHE
NOV20b CG56872-02   VPSDLTDGQFYLLIRKRIHLRPEDALFFFVNNTIPPTSATMGQLYEDSHE
gi|14211879|        VPSDLTDGQFYLLIRKRIHLRPEDALFFFVNNTIPPTSATMGQLYEDSHE
gi|10181206|        VPSDLTVGQFYFLIRKRIHLRPEDALFFFVNNTIPPTSATMGQLYEDNHE
gi|6005764|         VPSDLTVGQFYFLIRKRIHLRAEDALFFFVNNVIPPTSATMGQLYQEHHE
gi|12833187|        VPSDLTVGQFYFLIRKRIHLRAEDALFFFVNNVIPPTSATMGQLYQEHHE
gi|7291184|         VPSDLTVGQFYFLIRKRIHLRPEDALFFFVNNVIPPTSATMGSLYQEHHE 110       120
                   ....|....|....|....|.
NOV20a AC018946.4_A ELDFLYVAYSNESVYGK----
NOV20b CG56872-02   ELDFLYVAYSNESVYGK----
gi|14211879|        ELDFLYVAYSNESVYGK----
gi|10181206|        ELYFLYVAYSDESVYGK----
gi|6005764|         ELFFLYIAYSDESVYGL----
gi|12833187|        ELFFLYIAYSDESVYGL----
gi|7291184|         ELYFLYIAYSDEMVYGMAKIN
```

Other BLAST results include sequences from the Patp database, which is a proprietary database that contains sequences published in patents and patent publications. Patp results include those listed in Table 20G.

TABLE 20G

Patp BLASTP Analysis for NOV20

| Sequences producing High-scoring Segment Pairs | Protein/Organism | Length (aa) | Identity (%) | Positive (%) | E Value |
|---|---|---|---|---|---|
| patp: AAB01398 | Neuron-associated protein - *Homo sapiens* | 117 | 109/117 (93%) | 113/117 (96%) | 8.5e-56 |
| patp: AAM00943 | Human bone marrow protein, clone no: 419 - *Homo sapiens* | 144 | 109/117 (93%) | 113/117 (96%) | 8.5e-56 |
| patp: AAM00990 | Human bone marrow protein, clone no: 491 - *Homo sapiens* | 117 | 109/117 (93%) | 113/117 (96%) | 8.5e-56 |
| patp: AAG03857 | Human secreted protein, clone no: 7938 - *Homo sapiens* | 117 | 96/116 (82%) | 105/116 (90%) | 5.2e-49 |
| patp: AAG03859 | Human secreted protein, clone no: 7940 - *Homo sapiens* | 117 | 96/116 (82%) | 105/116 (90%) | 5.2e-49 |

TABLE 20H

Domain Analysis of NOV20

| Pfam analysis<br>PSSMs producing significant alignments: | Score<br>(bits) | E<br>value |
|---|---|---|
| gnl\|Pfam\|pfam02991 MAP1_LC3, Microtubule associated protein 1A/1B.<br>light chain 3 . . . . | 148 | 1e-37 |

```
gnl|Pfam|pfam02991, MAP1_LC3, Microtubule associated protein 1A/1B. light chain 3.
Light chain 3 is proposed to function primarily as a subunit of microtubule
associated proteins 1A and 1B and that its expression may regulate microtubule
binding activity.
CD-Length = 104 residues, 99.0% aligned
Score = 148 bits (374), Expect = 1e-37
NOV21:  14 RKKEGEKIRKKYPDRVPLIVEKAPKARVPDLDRRKYLVPSDLTDGQFYLLIRKRIHLRPE  73    (SEQ ID NO:285)
            |+ |  |+||+||||+|+|||| |+ +||+|++||||+|||  |||  +||||| | ||
Sbjct:   2 RRAESERIREKYPDRIPVIVEKAEKSDLPDIDKKKYLVPADLTVGQFVYIIRKRIQLSPE  61    (SEQ ID NO:286)

NOV21:  74 DALFFFVNNTIPPTSATMGQLYEDSHEEDDFLYVAYSNESVYG                   116
            |+|  |||||+|||||||   |||+  +||  |||+ ||  |+ +|
Sbjct:  62 KAIFLFVNNTLPPTSATMSALYEEEKDEDGFLYMVYSGENTFG                   104
```

The disclosed NOV20 nucleic acids encoding a GABA receptor associated protein-like proteins include the nucleic acids whose sequences are provided in Table 20A and Table 20C, or a fragment thereof. The invention also includes a mutant or variant nucleic acid any of whose bases may be changed from the corresponding base shown in Table 20A or Table 20C while still encoding a protein that maintains its GABA receptor associated protein-like activities and physiological functions, or a fragment of such a nucleic acids. The invention further includes nucleic acids whose sequences are complementary to those just described, including nucleic acid fragments that are complementary to any of the nucleic acids just described. The invention additionally includes nucleic acids or nucleic acid fragments, or complements thereto, whose structures include chemical modifications. Such modifications include, by way of nonlimiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject. In the mutant or variant nucleic acids, and their complements, up to about 12% of the bases may be so changed of NOV20a, and up to about 26% of the bases may be so changed of NOV20b.

The disclosed NOV20 protein of the invention includes the GABA receptor associated protein-like proteins whose sequences are provided in Table 20B and Table 20D. The invention also includes a mutant or variant protein any of whose residues may be changed from the corresponding residue shown in Table 20B or Table 20D while still encoding a protein that maintains its GABA receptor associated protein-like activities and physiological functions, or a functional fragment thereof. In the mutant or variant protein, up to about 7% of the residues may be so changed of NOV20a, and up to about 18% of the bases may be so changed of NOV20b.

Also encompassed within the invention are peptides and polypeptides comprising sequences having high binding affinity for any of the proteins of the invention, including such peptides and polypeptides that are fused to any carrier particle (or biologically expressed on the surface of a carrier) such as a bacteriophage particle. Additional SNP variants of NOV20 are disclosed in Examples.

The invention further encompasses antibodies and antibody fragments, such as $F_{ab}$ or $(F_{ab})_2$, that bind immunospecifically to any of the proteins of the invention for use in therapeutic or diagnostic methods. These antibodies may be generated according to methods known in the art, using prediction from hydrophbicity charts, as described in the "Anti-NOVX Antibodies" section below. The disclosed NOV20a protein has multiple hydrophilic regions, each of which can be used as an immunogen. In one embodiment, a contemplated NOV20a epitope is from about amino acids 1 to 68. In other specific embodiments, contemplated NOV20a epitopes are from about amino acids 73 to 80 and from about amino acids 87 to 117. These novel proteins can be used in assay systems for functional analysis of various human disorders, which will help in understanding of pathology of the disease and development of new drug targets for various disorders. The disclosed NOV20b protein has multiple hydrophilic regions, each of which can be used as an immunogen. In one embodiment, a contemplated NOV20b epitope is from about amino acids 1 to 68. In other specific embodiments, contemplated NOV20b epitopes are from about amino acids 73 to 80 and from about amino acids 87 to 117. These novel proteins can be used in assay systems for functional analysis of various human disorders, which will help in understanding of pathology of the disease and development of new drug targets for various disorders.

The GABA receptor associated disclosed in this invention is expressed in at least the following tissues: adipose, heart, brain, placenta, lung, liver, skeletal muscle, kidney, and pancreas. This information was derived from expression data from animal studies done by Curagen. Restriction fragments unique to the coding sequence of the protein of the invention were discovered in Cdna derived from metabolic tissues in rat models of obesity, hyperlipidemia, Type II diabetes and the Metabolic Syndrome X. Additional disease indications and tissue expression for NOV20 and NOV20 variants, if available, are presented in the Examples.

The protein similarity information, expression pattern, and map location for the GABA receptor associated-like protein and nucleic acid disclosed herein suggest that this GABA receptor associated may have important structural and/or physiological functions characteristic of the GABA receptor associated protein family. Therefore, the nucleic acids and proteins of the invention are useful in potential diagnostic and therapeutic applications and as a research tool. These include serving as a specific or selective nucleic acid or protein diagnostic and/or prognostic marker, wherein the presence or amount of the nucleic acid or the protein are to be assessed, as well as potential therapeutic applications such as the following: (i) a protein therapeutic, (ii) a small molecule drug target, (iii) an antibody target (therapeutic, diagnostic, drug targeting/cytotoxic antibody), (iv) a nucleic acid useful in gene therapy (gene delivery/gene ablation), and (v) a composition promoting tissue regeneration in vitro and in vivo (vi) biological defense weapon.

The nucleic acids and proteins of the invention are useful in potential diagnostic and therapeutic applications implicated in various diseases and disorders described below and/or other pathologies. For example, the compositions of the present invention will have efficacy for treatment of patients suffering from: Dyslipidemia, insulin resistance, obesity, hypertension and other conditions associated with the Metabolic Syndrome X, cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, transplantation, Von Hippel-Lindau (VHL) syndrome, Alzheimer's disease, stroke, hypercalceimia, Parkinson's disease, Huntington's disease, cerebral palsy, epilepsy, Lesch-Nyhan syndrome, multiple sclerosis, ataxia-telangiectasia, leukodystrophies, behavioral disorders, addiction, anxiety, pain, neurodegeneration, fertility, systemic lupus erythematosus, autoimmune disease, asthma, emphysema, allergies, ARDS, cirrhosis, diabetes, obesity, renal artery stenosis, interstitial nephritis, glomerulonephritis, polycystic kidney disease, renal tubular acidosis, IgA nephropathy, pancreatitis, as well as other diseases, disorders and conditions.

NOVX Nucleic Acids and Polypeptides

One aspect of the invention pertains to isolated nucleic acid molecules that encode NOVX polypeptides or biologically active portions thereof. Also included in the invention are nucleic acid fragments sufficient for use as hybridization probes to identify NOVX-encoding nucleic acids (e.g., NOVX mRNAs) and fragments for use as PCR primers for the amplification and/or mutation of NOVX nucleic acid molecules. As used herein, the term "nucleic acid molecule" is intended to include DNA molecules (e.g., cDNA or genomic DNA), RNA molecules (e.g., mRNA), analogs of the DNA or RNA generated using nucleotide analogs, and derivatives, fragments and homologs thereof. The nucleic acid molecule may be single-stranded or double-stranded, but preferably is comprised double-stranded DNA.

An NOVX nucleic acid can encode a mature NOVX polypeptide. As used herein, a "mature" form of a polypeptide or protein disclosed in the present invention is the product of a naturally occurring polypeptide or precursor form or proprotein. The naturally occurring polypeptide, precursor or proprotein includes, by way of nonlimiting example, the full-length gene product, encoded by the corresponding gene. Alternatively, it may be defined as the polypeptide, precursor or proprotein encoded by an ORF described herein. The product "mature" form arises, again by way of nonlimiting example, as a result of one or more naturally occurring processing steps as they may take place within the cell, or host cell, in which the gene product arises. Examples of such processing steps leading to a "mature" form of a polypeptide or protein include the cleavage of the N-terminal methionine residue encoded by the initiation codon of an ORF, or the proteolytic cleavage of a signal peptide or leader sequence. Thus a mature form arising from a precursor polypeptide or protein that has residues 1 to N, where residue 1 is the N-terminal methionine, would have residues 2 through N remaining after removal of the N-terminal methionine. Alternatively, a mature form arising from a precursor polypeptide or protein having residues 1 to N, in which an N-terminal signal sequence from residue 1 to residue M is cleaved, would have the residues from residue M+1 to residue N remaining. Further as used herein, a "mature" form of a polypeptide or protein may arise from a step of post-translational modification other than a proteolytic cleavage event. Such additional processes include, by way of non-limiting example, glycosylation, myristoylation or phosphorylation. In general, a mature polypeptide or protein may result from the operation of only one of these processes, or a combination of any of them.

The term "probes", as utilized herein, refers to nucleic acid sequences of variable length, preferably between at least about 10 nucleotides (nt), 100 nt, or as many as approximately, e.g., 6,000 nt, depending upon the specific use. Probes are used in the detection of identical, similar, or complementary nucleic acid sequences. Longer length probes are generally obtained from a natural or recombinant source, are highly specific, and much slower to hybridize than shorter-length oligomer probes. Probes may be single- or double-stranded and designed to have specificity in PCR, membrane-based hybridization technologies, or ELISA-like technologies.

The term "isolated" nucleic acid molecule, as utilized herein, is one, which is separated from other nucleic acid molecules which are present in the natural source of the nucleic acid. Preferably, an "isolated" nucleic acid is free of sequences which naturally flank the nucleic acid (i.e., sequences located at the 5'- and 3'-termini of the nucleic acid) in the genomic DNA of the organism from which the nucleic acid is derived. For example, in various embodiments, the isolated NOVX nucleic acid molecules can contain less than about 5 kb, 4 kb, 3 kb, 2 kb, 1 kb, 0.5 kb or 0.1 kb of nucleotide sequences which naturally flank the nucleic acid molecule in genomic DNA of the cell/tissue from which the nucleic acid is derived (e.g., brain, heart, liver, spleen, etc.). Moreover, an "isolated" nucleic acid molecule, such as a cDNA molecule, can be substantially free of other cellular material or culture medium when produced by recombinant techniques, or of chemical precursors or other chemicals when chemically synthesized.

A nucleic acid molecule of the invention, e.g., a nucleic acid molecule having the nucleotide sequence SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or a complement of this aforementioned nucleotide sequence, can be isolated using standard molecular biology techniques and the sequence information provided herein. Using all or a portion of the nucleic acid sequence of SEQ ID NOS: 1, 3, 5, 7, 9, 11, 13, 15, 17, 19, 21, 23, 25, 27, 29, 31, 33, 35, 37, 39, 41, 43, 45, 47, 49, and 51 as a hybridization probe, NOVX molecules can be isolated using standard hybridization and cloning techniques (e.g., as described in Sambrook, et al., (eds.), MOLECULAR CLONING: A LABORATORY MANUAL $2^{nd}$ Ed., Cold Spring Harbor Laboratory Press, Cold Spring Harbor, N.Y., 1989; and Ausubel, et al., (eds.), CURRENT PROTOCOLS IN MOLECULAR BIOLOGY, John Wiley & Sons, New York, N.Y., 1993.)

A nucleic acid of the invention can be amplified using cDNA, mRNA or alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to NOVX nucleotide sequences can be prepared by standard synthetic techniques, e.g., using an automated DNA synthesizer.

As used herein, the term "oligonucleotide" refers to a series of linked nucleotide residues, which oligonucleotide has a sufficient number of nucleotide bases to be used in a PCR reaction. A short oligonucleotide sequence may be based on, or designed from, a genomic or cDNA sequence and is used to amplify, confirm, or reveal the presence of an identical, similar or complementary DNA or RNA in a particular cell or tissue. Oligonucleotides comprise portions of a nucleic acid sequence having about 10 nt, 50 nt, or 100 nt in length, preferably about 15 nt to 30 nt in length. In one embodiment of the invention, an oligonucleotide comprising a nucleic acid molecule less than 100 nt in length would further comprise at least 6 contiguous nucleotides SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or a complement thereof. Oligonucleotides may be chemically synthesized and may also be used as probes.

In another embodiment, an isolated nucleic acid molecule of the invention comprises a nucleic acid molecule that is a complement of the nucleotide sequence shown in SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or a portion of this nucleotide sequence (e.g., a fragment that can be used as a probe or primer or a fragment encoding a biologically-active portion of an NOVX polypeptide). A nucleic acid molecule that is complementary to the nucleotide sequence shown SEQ ID NOS: 1, 3, 5, 7, 9, 11, 13, 15, 17, 19, 21, 23, 25, 27, 29, 31, 33, 35, 37, 39, 41, 43, 45, 47, 49, or 51 is one that is sufficiently complementary to the nucleotide sequence shown SEQ ID NOS: 1, 3, 5, 7, 9, 11, 13, 15, 17, 19, 21, 23, 25, 27, 29, 31, 33, 35, 37, 39, 41, 43, 45, 47, 49, or 51 that it can hydrogen bond with little or no mismatches to the nucleotide sequence shown SEQ ID NOS: 1, 3, 5, 7, 9, 11, 13, 15, 17, 19, 21, 23, 25, 27, 29, 31, 33, 35, 37, 39, 41, 43, 45, 47, 49, or 51, thereby forming a stable duplex.

As used herein, the term "complementary" refers to Watson-Crick or Hoogsteen base pairing between nucleotides units of a nucleic acid molecule, and the term "binding" means the physical or chemical interaction between two polypeptides or compounds or associated polypeptides or compounds or combinations thereof. Binding includes ionic, non-ionic, van der Waals, hydrophobic interactions, and the like. A physical interaction can be either direct or indirect. Indirect interactions may be through or due to the effects of another polypeptide or compound. Direct binding refers to interactions that do not take place through, or due to, the effect of another polypeptide or compound, but instead are without other substantial chemical intermediates.

Fragments provided herein are defined as sequences of at least 6 (contiguous) nucleic acids or at least 4 (contiguous) amino acids, a length sufficient to allow for specific hybridization in the case of nucleic acids or for specific recognition of an epitope in the case of amino acids, respectively, and are at most some portion less than a full length sequence. Fragments may be derived from any contiguous portion of a nucleic acid or amino acid sequence of choice. Derivatives are nucleic acid sequences or amino acid sequences formed from the native compounds either directly or by modification or partial substitution. Analogs are nucleic acid sequences or amino acid sequences that have a structure similar to, but not identical to, the native compound but differs from it in respect to certain components or side chains. Analogs may be synthetic or from a different evolutionary origin and may have a similar or opposite metabolic activity compared to wild type. Homologs are nucleic acid sequences or amino acid sequences of a particular gene that are derived from different species.

Derivatives and analogs may be full length or other than full length, if the derivative or analog contains a modified nucleic acid or amino acid, as described below. Derivatives or analogs of the nucleic acids or proteins of the invention include, but are not limited to, molecules comprising regions that are substantially homologous to the nucleic acids or proteins of the invention, in various embodiments, by at least about 70%, 80%, or 95% identity (with a preferred identity of 80–95%) over a nucleic acid or amino acid sequence of identical size or when compared to an aligned sequence in which the alignment is done by a computer homology program known in the art, or whose encoding nucleic acid is capable of hybridizing to the complement of a sequence encoding the aforementioned proteins under stringent, moderately stringent, or low stringent conditions. See e.g. Ausubel, et al., CURRENT PROTOCOLS IN MOLECULAR BIOLOGY, John Wiley & Sons, New York, N.Y., 1993, and below.

A "homologous nucleic acid sequence" or "homologous amino acid sequence," or variations thereof, refer to sequences characterized by a homology at the nucleotide level or amino acid level as discussed above. Homologous nucleotide sequences encode those sequences coding for isoforms of NOVX polypeptides. Isoforms can be expressed in different tissues of the same organism as a result of, for example, alternative splicing of RNA. Alternatively, isoforms can be encoded by different genes. In the invention, homologous nucleotide sequences include nucleotide sequences encoding for an NOVX polypeptide of species other than humans, including, but not limited to: vertebrates, and thus can include, e.g., frog, mouse, rat, rabbit, dog, cat cow, horse, and other organisms. Homologous nucleotide sequences also include, but are not limited to, naturally occurring allelic variations and mutations of the nucleotide sequences set forth herein. A homologous nucleotide sequence does not, however, include the exact nucleotide sequence encoding human NOVX protein. Homologous nucleic acid sequences include those nucleic acid sequences that encode conservative amino acid substitutions (see below) in SEQ ID NOS: 1, 3, 5, 7, 9, 11, 13, 15, 17, 19, 21, 23, 25, 27, 29, 31, 33, 35, 37, 39, 41, 43, 45, 47, 49, and 51, as well as a polypeptide possessing NOVX biological activity. Various biological activities of the NOVX proteins are described below.

An NOVX polypeptide is encoded by the open reading frame ("ORF") of an NOVX nucleic acid. An ORF corresponds to a nucleotide sequence that could potentially be translated into a polypeptide. A stretch of nucleic acids comprising an ORF is uninterrupted by a stop codon. An ORF that represents the coding sequence for a full protein begins with an ATG "start" codon and terminates with one of the three "stop" codons, namely, TAA, TAG, or TGA. For the purposes of this invention, an ORF may be any part of a coding sequence, with or without a start codon, a stop codon, or both. For an ORF to be considered as a good candidate for coding for a bona fide cellular protein, a minimum size requirement is often set, e.g. a stretch of DNA that would encode a protein of 50 amino acids or more.

The nucleotide sequences determined from the cloning of the human NOVX genes allows for the generation of probes and primers designed for use in identifying and/or cloning NOVX homologues in other cell types e.g. from other tissues, as well as NOVX homologues from other vertebrates. The probe/primer typically comprises substantially purified oligonucleotide. The oligonucleotide typically comprises a region of nucleotide sequence that hybridizes under stringent conditions to at least about 12, 25, 50, 100, 150, 200, 250, 300, 350 or 400 consecutive sense strand nucleotide sequence SEQ ID NOS: 1, 3, 5, 7, 9, 11, 13, 15, 17, 19, 21, 23, 25, 27, 29, 31, 33, 35, 37, 39, 41, 43, 45, 47, 49, or 51; or an anti-sense strand nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, or 51; or of a naturally occurring mutant of SEQ ID NOS: 1, 3, 5, 7, 9, 11, 13, 15, 17, 19, 21, 23, 25, 27, 29, 31, 33, 35, 37, 39, 41, 43, 45, 47, 49, and 51.

Probes based on the human NOVX nucleotide sequences can be used to detect transcripts or genomic sequences encoding the same or homologous proteins. In various embodiments, the probe further comprises a label group attached thereto, e.g. the label group can be a radioisotope, a fluorescent compound, an enzyme, or an enzyme co-factor. Such probes can be used as a part of a diagnostic test kit for identifying cells or tissues which mis-express an NOVX protein, such as by measuring a level of an NOVX-encoding nucleic acid in a sample of cells from a subject e.g., detecting NOVX mRNA levels or determining whether a genomic NOVX gene has been mutated or deleted.

"A polypeptide having a biologically-active portion of an NOVX polypeptide" refers to polypeptides exhibiting activity similar, but not necessarily identical to, an activity of a polypeptide of the invention, including mature forms, as measured in a particular biological assay, with or without dose dependency. A nucleic acid fragment encoding a "biologically-active portion of NOVX" can be prepared by isolating a portion SEQ ID NOS: 1, 3, 5, 7, 9, 11, 13, 15, 17, 19, 21, 23, 25, 27, 29, 31, 33, 35, 37, 39, 41, 43, 45, 47, 49, or 51,that encodes a polypeptide having an NOVX biological activity (the biological activities of the NOVX proteins are described below), expressing the encoded portion of NOVX protein (e.g., by recombinant expression in vitro) and assessing the activity of the encoded portion of NOVX.

NOVX Nucleic Acid and Polypeptide Variants

The invention further encompasses nucleic acid molecules that differ from the nucleotide sequences shown in SEQ ID NOS: 1, 3, 5, 7, 9, 11, 13, 15, 17, 19, 21, 23, 25, 27, 29, 31, 33, 35, 37, 39, 41, 43, 45, 47, 49, and 51 due to degeneracy of the genetic code and thus encode the same NOVX proteins as that encoded by the nucleotide sequences shown in SEQ ID NOS: 1, 3, 5, 7, 9, 11, 13, 15, 17, 19, 21, 23, 25, 27, 29, 31, 33, 35, 37, 39, 41, 43, 45, 47, 49, and 51. In another embodiment, an isolated nucleic acid molecule of the invention has a nucleotide sequence encoding a protein having an amino acid sequence shown in SEQ ID NOS: 2, 4, 6, 8, 10, 12, 14, 16, 18, 20, 22, 24, 26, 28, 30, 32, 34, 36, 38, 40, 42, 44, 46, 48, 50, or 52.

In addition to the human NOVX nucleotide sequences shown in SEQ ID NOS: 1, 3, 5, 7, 9, 11, 13, 15, 17, 19, 21, 23, 25, 27, 29, 31, 33, 35, 37, 39, 41, 43, 45, 47, 49, and 51, it will be appreciated by those skilled in the art that DNA sequence polymorphisms that lead to changes in the amino acid sequences of the NOVX polypeptides may exist within a population (e.g., the human population). Such genetic polymorphism in the NOVX genes may exist among individuals within a population due to natural allelic variation. As used herein, the terms "gene" and "recombinant gene" refer to nucleic acid molecules comprising an open reading frame (ORF) encoding an NOVX protein, preferably a vertebrate NOVX protein. Such natural allelic variations can typically result in 1–5% variance in the nucleotide sequence of the NOVX genes. Any and all such nucleotide variations and resulting amino acid polymorphisms in the NOVX polypeptides, which are the result of natural allelic variation and that do not alter the functional activity of the NOVX polypeptides, are intended to be within the scope of the invention.

Moreover, nucleic acid molecules encoding NOVX proteins from other species, and thus that have a nucleotide sequence that differs from the human SEQ ID NOS: 1, 3, 5, 7, 9, 11, 13, 15, 17, 19, 21, 23, 25, 27, 29, 31, 33, 35, 37, 39, 41, 43, 45, 47, 49, and 51 are intended to be within the scope of the invention. Nucleic acid molecules corresponding to natural allelic variants and homologues of the NOVX cDNAs of the invention can be isolated based on their homology to the human NOVX nucleic acids disclosed herein using the human cDNAs, or a portion thereof, as a hybridization probe according to standard hybridization techniques under stringent hybridization conditions.

Accordingly, in another embodiment, an isolated nucleic acid molecule of the invention is at least 6 nucleotides in length and hybridizes under stringent conditions to the nucleic acid molecule comprising the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, and 51. In another embodiment, the nucleic acid is at least 10, 25, 50, 100, 250, 500, 750, 1000, 1500, or 2000 or more nucleotides in length. In yet another embodiment, an isolated nucleic acid molecule of the invention hybridizes to the coding region. As used herein, the term "hybridizes under stringent conditions" is intended to describe conditions for hybridization and washing under which nucleotide sequences at least 60% homologous to each other typically remain hybridized to each other.

Homologs (i.e., nucleic acids encoding NOVX proteins derived from species other than human) or other related sequences (e.g., paralogs) can be obtained by low, moderate or high stringency hybridization with all or a portion of the particular human sequence as a probe using methods well known in the art for nucleic acid hybridization and cloning.

As used herein, the phrase "stringent hybridization conditions" refers to conditions under which a probe, primer or oligonucleotide will hybridize to its target sequence, but to no other sequences. Stringent conditions are sequence-dependent and will be different in different circumstances. Longer sequences hybridize specifically at higher temperatures than shorter sequences. Generally, stringent conditions are selected to be about 5° C. lower than the thermal melting point (Tm) for the specific sequence at a defined ionic strength and pH. The Tm is the temperature (under defined ionic strength, pH and nucleic acid concentration) at which 50% of the probes complementary to the target sequence hybridize to the target sequence at equilibrium. Since the target sequences are generally present at excess, at Tm, 50% of the probes are occupied at equilibrium. Typically, stringent conditions will be those in which the salt concentration is less than about 1.0 M sodium ion, typically about 0.01 to 1.0 M sodium ion (or other salts) at pH 7.0 to 8.3 and the temperature is at least about 30° C. for short probes, primers or oligonucleotides (e.g., 10 nt to 50 nt) and at least about 60° C. for longer probes, primers and oligonucleotides. Stringent conditions may also be achieved with the addition of destabilizing agents, such as formamide.

Stringent conditions are known to those skilled in the art and can be found in Ausubel, et al., (eds.), CURRENT PROTOCOLS IN MOLECULAR BIOLOGY, John Wiley & Sons, N.Y. (1989), 6.3.1–6.3.6. Preferably, the conditions are such that sequences at least about 65%, 70%, 75%, 85%, 90%, 95%, 98%, or 99% homologous to each other typically remain hybridized to each other. A non-limiting example of stringent hybridization conditions are hybridization in a high salt buffer comprising 6×SSC, 50 mM Tris-HCl (pH 7.5), 1 mM EDTA, 0.02% PVP, 0.02% Ficoll, 0.02% BSA, and 500 mg/ml denatured salmon sperm DNA at 65° C., followed by one or more washes in 0.2×SSC, 0.01% BSA at 50° C. An isolated nucleic acid molecule of the invention that hybridizes under stringent conditions to the sequences SEQ ID NOS: 1, 3, 5, 7, 9, 11, 13, 15, 17, 19, 21, 23, 25, 27, 29, 31, 33, 35, 37, 39, 41, 43, 45, 47, 49, and 51, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In a second embodiment, a nucleic acid sequence that is hybridizable to the nucleic acid molecule comprising the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or fragments, analogs or derivatives thereof, under conditions of moderate stringency is provided. A non-limiting example of moderate stringency hybridization conditions are hybridization in 6×SSC, 5× Denhardt's solution, 0.5% SDS and 100 mg/ml denatured salmon sperm DNA at 55° C., followed by one or more washes in 1×SSC, 0.1% SDS at 37° C. Other conditions of moderate stringency that may be used are well-known within the art. See, e.g., Ausubel, et al. (eds.), 1993, CURRENT PROTOCOLS IN MOLECULAR BIOLOGY, John Wiley & Sons, NY, and Kriegler, 1990; GENE TRANSFER AND EXPRESSION, A LABORATORY MANUAL, Stockton Press, NY.

In a third embodiment, a nucleic acid that is hybridizable to the nucleic acid molecule comprising the nucleotide sequences SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or fragments, analogs or derivatives thereof, under conditions of low stringency, is provided. A non-limiting example of low stringency hybridization conditions are hybridization in 35% formamide, 5×SSC, 50 mM Tris-HCl (pH 7.5), 5 mM EDTA, 0.02% PVP, 0.02% Ficoll, 0.2% BSA, 100 mg/ml denatured salmon sperm DNA, 10% (wt/vol) dextran sulfate at 40° C., followed by one or more washes in 2×SSC, 25 mM Tris-HCl (pH 7.4), 5 mM EDTA, and 0.1% SDS at 50° C. Other conditions of low stringency that may be used are well known in the art (e.g., as employed for cross-species hybridizations). See, e.g., Ausubel, et al. (eds.), 1993, CURRENT PROTOCOLS IN MOLECULAR BIOLOGY, John Wiley & Sons, NY, and Kriegler, 1990, GENE TRANSFER AND EXPRESSION, A LABORATORY MANUAL, Stockton Press, NY; Shilo and Weinberg, 1981. *Proc Natl Acad Sci USA* 78: 6789–6792.

Conservative Mutations

In addition to naturally-occurring allelic variants of NOVX sequences that may exist in the population, the skilled artisan will further appreciate that changes can be introduced by mutation into the nucleotide sequences SEQ ID NOS: 1, 3, 5, 7, 9, 11, 13, 15, 17, 19, 21, 23, 25, 27, 29, 31, 33, 35, 37, 39, 41, 43, 45, 47, 49, and 51, thereby leading to changes in the amino acid sequences of the encoded NOVX proteins, without altering the functional ability of said NOVX proteins. For example, nucleotide substitutions leading to amino acid substitutions at "non-essential" amino acid residues can be made in the sequence SEQ ID NOS: 2, 4, 6, 8, 10, 12, 14, 16, 18, 20, 22, 24, 26, 28, 30, 32, 34, 36, 38, 40, 42, 44, 46, 48, 50, or 52. A "non-essential" amino acid residue is a residue that can be altered from the wild-type sequences of the NOVX proteins without altering their biological activity, whereas an "essential" amino acid residue is required for such biological activity. For example, amino acid residues that are conserved among the NOVX proteins of the invention are predicted to be particularly non-amenable to alteration. Amino acids for which conservative substitutions can be made are well-known within the art.

Another aspect of the invention pertains to nucleic acid molecules encoding NOVX proteins that contain changes in amino acid residues that are not essential for activity. Such NOVX proteins differ in amino acid sequence from SEQ ID NOS: 2, 4, 6, 8, 10, 12, 14, 16, 18, 20, 22, 24, 26, 28, 30, 32, 34, 36, 38, 40, 42, 44, 46, 48, 50, and 52 yet retain biological activity. In one embodiment, the isolated nucleic acid molecule comprises a nucleotide sequence encoding a protein, wherein the protein comprises an amino acid sequence at least about 45% homologous to the amino acid sequences SEQ ID NOS: 2, 4, 6, 8, 10, 12, 14, 16, 18, 20, 22, 24, 26, 28, 30, 32, 34, 36, 38, 40, 42, 44, 46, 48, 50, and 52. Preferably, the protein encoded by the nucleic acid molecule is at least about 60% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, and 52; more preferably at least about 70% homologous SEQ ID NOS: 2, 4, 6, 8, 10, 12, 14, 16, 18, 20, 22, 24, 26, 28, 30, 32, 34, 36, 38, 40, 42, 44, 46, 48, 50, or 52; still more preferably at least about 80% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, or 52; even more preferably at least about 90% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, or 52; and most preferably at least about 95% homologous to SEQ ID NOS: 2, 4, 6, 8, 10, 12, 14, 16, 18, 20, 22, 24, 26, 28, 30, 32, 34, 36, 38, 40, 42, 44, 46, 48, 50, or 52.

An isolated nucleic acid molecule encoding an NOVX protein homologous to the protein of SEQ ID NOS: 2, 4, 6, 8, 10, 12, 14, 16, 18, 20, 22, 24, 26, 28, 30, 32, 34, 36, 38, 40, 42, 44, 46, 48, 50, or 52 can be created by introducing one or more nucleotide substitutions, additions or deletions into the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, and 51, such that one or more amino acid substitutions, additions or deletions are introduced into the encoded protein.

Mutations can be introduced into SEQ ID NOS: 1, 3, 5, 7, 9, 11, 13, 15, 17, 19, 21, 23, 25, 27, 29, 31, 33, 35, 37, 39, 41, 43, 45, 47, 49, and 51 by standard techniques, such as site-directed mutagenesis and PCR-mediated mutagenesis. Preferably, conservative amino acid substitutions are made at one or more predicted, non-essential amino acid residues. A "conservative amino acid substitution" is one in which the amino acid residue is replaced with an amino acid residue having a similar side chain. Families of amino acid residues having similar side chains have been defined within the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in the NOVX protein is replaced with another amino acid residue from the same side chain family. Alternatively, in another embodiment, mutations can be introduced randomly along all or part of an NOVX coding sequence, such as by saturation mutagenesis, and the resultant mutants can be screened for NOVX biological activity to identify mutants that retain activity. Following mutagenesis of SEQ ID NOS: 1, 3, 5, 7, 9, 11, 13, 15, 17, 19, 21, 23, 25, 27, 29, 31, 33, 35, 37, 39, 41, 43, 45, 47, 49, and 51, the encoded protein can be expressed by any recombinant technology known in the art and the activity of the protein can be determined.

The relatedness of amino acid families may also be determined based on side chain interactions. Substituted amino acids may be fully conserved "strong" residues or fully conserved "weak" residues. The "strong" group of conserved amino acid residues may be any one of the following groups: STA, NEQK, NHQK, NDEQ, QHRK, MILV, MILF, HY, FYW, wherein the single letter amino acid codes are grouped by those amino acids that may be substituted for each other. Likewise, the "weak" group of conserved residues may be any one of the following: CSA, ATV, SAG, STNK, STPA, SGND, SNDEQK, NDEQHK, NEQHRK, VLIM, HFY, wherein the letters within each group represent the single letter amino acid code.

In one embodiment, a mutant NOVX protein can be assayed for (i) the ability to form protein: protein interactions with other NOVX proteins, other cell-surface proteins, or biologically-active portions thereof, (ii) complex formation between a mutant NOVX protein and an NOVX ligand; or (iii) the ability of a mutant NOVX protein to bind to an intracellular target protein or biologically-active portion thereof, (e.g. avidin proteins).

In yet another embodiment, a mutant NOVX protein can be assayed for the ability to regulate a specific biological function (e.g., regulation of insulin release).

Antisense Nucleic Acids

Another aspect of the invention pertains to isolated antisense nucleic acid molecules that are hybridizable to or complementary to the nucleic acid molecule comprising the nucleotide sequence of SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or fragments, analogs or derivatives thereof. An "antisense" nucleic acid comprises a nucleotide sequence that is complementary to a "sense" nucleic acid encoding a protein (e.g., complementary to the coding strand of a double-stranded cDNA molecule or complementary to an mRNA sequence). In specific aspects, antisense nucleic acid molecules are provided that comprise a sequence complementary to at least about 10, 25, 50, 100, 250 or 500 nucleotides or an entire NOVX coding strand, or to only a portion thereof. Nucleic acid molecules encoding fragments, homologs, derivatives and analogs of an NOVX protein of SEQ ID NOS: 2, 4, 6, 8, 10, 12, 14, 16, 18, 20, 22, 24, 26, 28, 30, 32, 34, 36, 38, 40, 42, 44, 46, 48, 50, or 52, or antisense nucleic acids complementary to an NOVX nucleic acid sequence of SEQ ID NOS: 1, 3, 5, 7, 9, 11, 13, 15, 17, 19, 21, 23, 25, 27, 29, 31, 33, 35, 37, 39, 41, 43, 45, 47, 49, and 51, are additionally provided.

In one embodiment, an antisense nucleic acid molecule is antisense to a "coding region" of the coding strand of a nucleotide sequence encoding an NOVX protein. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding the NOVX protein. The term "noncoding region" refers to 5' and 3' sequences which flank the coding region that are not translated into amino acids (i.e., also referred to as 5' and 3' untranslated regions).

Given the coding strand sequences encoding the NOVX protein disclosed herein, antisense nucleic acids of the invention can be designed according to the rules of Watson and Crick or Hoogsteen base pairing. The antisense nucleic acid molecule can be complementary to the entire coding region of NOVX mRNA, but more preferably is an oligonucleotide that is antisense to only a portion of the coding or noncoding region of NOVX mRNA. For example, the antisense oligonucleotide can be complementary to the region surrounding the translation start site of NOVX mRNA. An antisense oligonucleotide can be, for example, about 5, 10, 15, 20, 25, 30, 35, 40, 45 or 50 nucleotides in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally-occurring nucleotides or variously modified nucleotides designed to increase the biological stability of the molecules or to increase the physical stability of the duplex formed between the antisense and sense nucleic acids (e.g., phosphorothioate derivatives and acridine substituted nucleotides can be used).

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding an NOVX protein to thereby inhibit expression of the protein (e.g., by inhibiting transcription and/or translation). The hybridization can be by conventional nucleotide complementarity to form a stable duplex, or, for example, in the case of an antisense nucleic acid molecule that binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface (e.g., by linking the antisense nucleic acid molecules to peptides or antibodies that bind to cell surface receptors or antigens). The antisense nucleic acid molecules can also be delivered to cells using the vectors described herein. To achieve sufficient nucleic acid molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other. See, e.g., Gaultier, et al., 1987. *Nucl. Acids Res.* 15: 6625–6641. The antisense nucleic acid molecule can also comprise a 2'-o-methylribonucleotide (See, e.g., Inoue, et al. 1987. *Nucl. Acids Res.* 15: 6131–6148) or a chimeric RNA-DNA analogue (See, e.g., Inoue, et al., 1987. *FEBS Lett.* 215: 327–330.

Ribozymes and PNA Moieties

Nucleic acid modifications include, by way of non-limiting example, modified bases, and nucleic acids whose sugar phosphate backbones are modified or derivatized. These modifications are carried out at least in part to enhance the chemical stability of the modified nucleic acid, such that they may be used, for example, as antisense binding nucleic acids in therapeutic applications in a subject.

In one embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes as described in Haselhoff and Gerlach 1988. *Nature* 334: 585–591) can be used to catalytically cleave NOVX mRNA transcripts to thereby inhibit translation of NOVX mRNA. A ribozyme having specificity for an NOVX-encoding nucleic acid can be designed based upon the nucleotide sequence of an NOVX cDNA disclosed herein (i.e., SEQ ID NOS: 1, 3, 5, 7, 9, 11, 13, 15, 17, 19, 21, 23, 25, 27, 29, 31, 33, 35, 37, 39, 41, 43, 45, 47, 49, and 51). For example, a derivative of a Tetrahymena L-19 IVS RNA can be constructed in which the nucleotide sequence of the active site is complementary to the nucleotide sequence to be cleaved in an NOVX-encoding mRNA. See, e.g., U.S. Pat. No. 4,987,071 to Cech, et al. and U.S. Pat. No. 5,116,742 to Cech, et al. NOVX mRNA can also be used to select a catalytic RNA having a specific ribonuclease activity from a pool of RNA molecules. See, e.g., Bartel et al., (1993) *Science* 261:1411–1418.

Alternatively, NOVX gene expression can be inhibited by targeting nucleotide sequences complementary to the regulatory region of the NOVX nucleic acid (e.g., the NOVX promoter and/or enhancers) to form triple helical structures that prevent transcription of the NOVX gene in target cells. See, e.g., Helene, 1991. *Anticancer Drug Des.* 6: 569–84; Helene, et al. 1992. *Ann. N.Y. Acad. Sci.* 660: 27–36; Maher, 1992. *Bioassays* 14: 807–15.

In various embodiments, the NOVX nucleic acids can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids. See, e.g., Hyrup, et al., 1996. *Bioorg Med Chem* 4: 5–23. As used herein, the terms "peptide nucleic acids" or "PNAs" refer to nucleic acid mimics (e.g., DNA mimics) in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup, et al., 1996. supra; Perry-O'Keefe, et al., 1996. *Proc. Natl. Acad. Sci. USA* 93: 14670–14675.

PNAs of NOVX can be used in therapeutic and diagnostic applications. For example, PNAs can be used as antisense or antigene agents for sequence-specific modulation of gene expression by, e.g., inducing transcription or translation arrest or inhibiting replication. PNAs of NOVX can also be used, for example, in the analysis of single base pair mutations in a gene (e.g., PNA directed PCR clamping; as artificial restriction enzymes when used in combination with other enzymes, e.g., $S_1$ nucleases (See, Hyrup, et al., 1996. supra); or as probes or primers for DNA sequence and hybridization (See, Hyrup, et al., 1996, supra; Perry-O'Keefe, et al., 1996. supra).

In another embodiment, PNAs of NOVX can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras of NOVX can be generated that may combine the advantageous properties of PNA and DNA. Such chimeras allow DNA recognition enzymes (e.g., RNase H and DNA polymerases) to interact with the DNA portion while the PNA portion would provide high binding affinity and specificity. PNA-DNA chimeras can be linked using linkers of appropriate lengths selected in terms of base stacking, number of bonds between the nucleobases, and orientation (see, Hyrup, et al., 1996. supra). The synthesis of PNA-DNA chimeras can be performed as described in Hyrup, et al, 1996. supra and Finn, et al., 1996. *Nucl Acids Res* 24: 3357–3363. For example, a DNA chain can be synthesized on a solid support using standard phosphoramidite coupling chemistry, and modified nucleoside analogs, e.g., 5'-(4-methoxytrityl)amino-5'-deoxy-thymidine phosphoramidite, can be used between the PNA and the 5' end of DNA. See, e.g., Mag, et al., 1989. *Nucl Acid Res* 17: 5973–5988. PNA monomers are then coupled in a stepwise manner to produce a chimeric molecule with a 5' PNA segment and a 3' DNA segment. See, e.g., Finn, et al., 1996. supra. Alternatively, chimeric molecules can be synthesized with a 5' DNA segment and a 3' PNA segment. See, e.g., Petersen, et al., 1975. *Bioorg. Med. Chem. Lett.* 5: 1119–11124.

In other embodiments, the oligonucleotide may include other appended groups such as peptides (e.g., for targeting host cell receptors in vivo), or agents facilitating transport across the cell membrane (see, e.g., Letsinger, et al., 1989. *Proc. Natl. Acad. Sci. U.S.A.* 86: 6553–6556; Lemaitre, et al., 1987. *Proc. Natl. Acad. Sci.* 84: 648–652; PCT Publication No. WO88/09810) or the blood-brain barrier (see, e.g., PCT Publication No. WO 89/10134). In addition, oligonucleotides can be modified with hybridization triggered cleavage agents (see, e.g., Krol, et al., 1988. *BioTechniques* 6:958–976) or intercalating agents (see, e.g., Zon, 1988. *Pharm. Res.* 5: 539–549). To this end, the oligonucleotide may be conjugated to another molecule, e.g., a peptide, a hybridization triggered cross-linking agent, a transport agent, a hybridization-triggered cleavage agent, and the like.

NOVX Polypeptides

A polypeptide according to the invention includes a polypeptide including the amino acid sequence of NOVX polypeptides whose sequences are provided in SEQ ID NOS: 2, 4, 6, 8, 10, 12, 14, 16, 18, 20, 22, 24, 26, 28, 30, 32, 34, 36, 38, 40, 42, 44, 46, 48, 50, or 52. The invention also includes a mutant or variant protein any of whose residues may be changed from the corresponding residues shown in SEQ ID NOS: 2, 4, 6, 8, 10, 12, 14, 16, 18, 20, 22, 24, 26, 28, 30, 32, 34, 36, 38, 40, 42, 44, 46, 48, 50, or 52 while still encoding a protein that maintains its NOVX activities and physiological functions, or a functional fragment thereof.

In general, an NOVX variant that preserves NOVX-like function includes any variant in which residues at a particular position in the sequence have been substituted by other amino acids, and further include the possibility of inserting an additional residue or residues between two residues of the parent protein as well as the possibility of deleting one or more residues from the parent sequence. Any amino acid substitution, insertion, or deletion is encompassed by the invention. In favorable circumstances, the substitution is a conservative substitution as defined above.

One aspect of the invention pertains to isolated NOVX proteins, and biologically-active portions thereof, or derivatives, fragments, analogs or homologs thereof. Also provided are polypeptide fragments suitable for use as immunogens to raise anti-NOVX antibodies. In one embodiment, native NOVX proteins can be isolated from cells or tissue sources by an appropriate purification scheme using standard protein purification techniques. In another embodiment, NOVX proteins are produced by recombinant DNA techniques. Alternative to recombinant expression, an NOVX protein or polypeptide can be synthesized chemically using standard peptide synthesis techniques.

An "isolated" or "purified" polypeptide or protein or biologically-active portion thereof is substantially free of cellular material or other contaminating proteins from the cell or tissue source from which the NOVX protein is derived, or substantially free from chemical precursors or other chemicals when chemically synthesized. The language "substantially free of cellular material" includes preparations of NOVX proteins in which the protein is separated from cellular components of the cells from which it is isolated or recombinantly-produced. In one embodiment, the language "substantially free of cellular material" includes preparations of NOVX proteins having less than about 30% (by dry weight) of non-NOVX proteins (also referred to herein as a "contaminating protein"), more preferably less than about 20% of non-NOVX proteins, still more preferably less than about 10% of non-NOVX proteins, and most preferably less than about 5% of non-NOVX proteins. When the NOVX protein or biologically-active portion thereof is recombinantly-produced, it is also preferably substantially free of culture medium, i.e., culture medium represents less than about 20%, more preferably less than about 10%, and most preferably less than about 5% of the volume of the NOVX protein preparation.

The language "substantially free of chemical precursors or other chemicals" includes preparations of NOVX proteins in which the protein is separated from chemical precursors or other chemicals that are involved in the synthesis of the protein. In one embodiment, the language "substantially free of chemical precursors or other chemicals" includes preparations of NOVX proteins having less than about 30% (by dry weight) of chemical precursors or non-NOVX chemicals, more preferably less than about 20% chemical precursors or non-NOVX chemicals, still more preferably less than about 10% chemical precursors or non-NOVX chemicals, and most preferably less than about 5% chemical precursors or non-NOVX chemicals.

Biologically-active portions of NOVX proteins include peptides comprising amino acid sequences sufficiently homologous to or derived from the amino acid sequences of the NOVX proteins (e.g., the amino acid sequence shown in SEQ ID NOS: 2, 4, 6, 8, 10, 12, 14, 16, 18, 20, 22, 24, 26, 28, 30, 32, 34, 36, 38, 40, 42, 44, 46, 48, 50, or 52) that include fewer amino acids than the full-length NOVX proteins, and exhibit at least one activity of an NOVX protein. Typically, biologically-active portions comprise a domain or motif with at least one activity of the NOVX protein. A biologically-active portion of an NOVX protein can be a polypeptide which is, for example, 10, 25, 50, 100 or more amino acid residues in length.

Moreover, other biologically-active portions, in which other regions of the protein are deleted, can be prepared by recombinant techniques and evaluated for one or more of the functional activities of a native NOVX protein.

In an embodiment, the NOVX protein has an amino acid sequence shown SEQ ID NOS: 2, 4, 6, 8, 10, 12, 14, 16, 18, 20, 22, 24, 26, 28, 30, 32, 34, 36, 38, 40, 42, 44, 46, 48, 50, or 52. In other embodiments, the NOVX protein is substantially homologous to SEQ ID NOS: 2, 4, 6, 8, 10, 12, 14, 16, 18, 20, 22, 24, 26, 28, 30, 32, 34, 36, 38, 40, 42, 44, 46, 48, 50, or 52, and retains the functional activity of the protein of SEQ ID NOS: 2, 4, 6, 8, 10, 12, 14, 16, 18, 20, 22, 24, 26, 28, 30, 32, 34, 36, 38, 40, 42, 44, 46, 48, 50, or 52, yet differs in amino acid sequence due to natural allelic variation or mutagenesis, as described in detail, below. Accordingly, in another embodiment, the NOVX protein is a protein that comprises an amino acid sequence at least about 45% homologous to the amino acid sequence SEQ ID NOS: 2, 4, 6, 8, 10, 12, 14, 16, 18, 20, 22, 24, 26, 28, 30, 32, 34, 36, 38, 40, 42, 44, 46, 48, 50, or 52, and retains the functional activity of the NOVX proteins of SEQ ID NOS: 2, 4, 6, 8, 10, 12, 14, 16, 18, 20, 22, 24, 26, 28, 30, 32, 34, 36, 38, 40, 42, 44, 46, 48, 50, or 52.

Determining Homology between Two or more Sequences

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are homologous at that position (i.e., as used herein amino acid or nucleic acid "homology" is equivalent to amino acid or nucleic acid "identity").

The nucleic acid sequence homology may be determined as the degree of identity between two sequences. The homology may be determined using computer programs known in the art, such as GAP software provided in the GCG program package. See, Needleman and Wunsch, 1970. *J Mol Biol* 48: 443–453. Using GCG GAP software with the following settings for nucleic acid sequence comparison: GAP creation penalty of 5.0 and GAP extension penalty of 0.3, the coding region of the analogous nucleic acid sequences referred to above exhibits a degree of identity preferably of at least 70%, 75%, 80%, 85%, 90%, 95%, 98%, or 99%, with the CDS (encoding) part of the DNA sequence shown in SEQ ID NOS: 1, 3, 5, 7, 9, 11, 13, 15, 17, 19, 21, 23, 25, 27, 29, 31, 33, 35, 37, 39, 41, 43, 45, 47, 49, and 51.

The term "sequence identity" refers to the degree to which two polynucleotide or polypeptide sequences are identical on a residue-by-residue basis over a particular region of comparison. The term "percentage of sequence identity" is calculated by comparing two optimally aligned sequences over that region of comparison, determining the number of positions at which the identical nucleic acid base (e.g., A, T, C, G, U, or I, in the case of nucleic acids) occurs in both sequences to yield the number of matched positions, dividing the number of matched positions by the total number of positions in the region of comparison (i.e., the window size), and multiplying the result by 100 to yield the percentage of sequence identity. The term "substantial identity" as used herein denotes a characteristic of a polynucleotide sequence, wherein the polynucleotide comprises a sequence that has at least 80 percent sequence identity, preferably at least 85 percent identity and often 90 to 95 percent sequence identity, more usually at least 99 percent sequence identity as compared to a reference sequence over a comparison region.

Chimeric and Fusion Proteins

The invention also provides NOVX chimeric or fusion proteins. As used herein, an NOVX "chimeric protein" or "fusion protein" comprises an NOVX polypeptide operatively-linked to a non-NOVX polypeptide. An "NOVX polypeptide" refers to a polypeptide having an amino acid sequence corresponding to an NOVX protein SEQ ID NOS: 2, 4, 6, 8, 10, 12, 14, 16, 18, 20, 22, 24, 26, 28, 30, 32, 34, 36, 38, 40, 42, 44, 46, 48, 50, or 52), whereas a "non-NOVX polypeptide" refers to a polypeptide having an amino acid sequence corresponding to a protein that is not substantially homologous to the NOVX protein, e.g., a protein that is different from the NOVX protein and that is derived from the same or a different organism. Within an NOVX fusion protein the NOVX polypeptide can correspond to all or a portion of an NOVX protein. In one embodiment, an NOVX fusion protein comprises at least one biologically-active portion of an NOVX protein. In another embodiment, an NOVX fusion protein comprises at least two biologically-active portions of an NOVX protein. In yet another embodiment, an NOVX fusion protein comprises at least three biologically-active portions of an NOVX protein. Within the fusion protein, the term "operatively-linked" is intended to indicate that the NOVX polypeptide and the non-NOVX polypeptide are fused in-frame with one another. The non-NOVX polypeptide can be fused to the N-terminus or C-terminus of the NOVX polypeptide.

In one embodiment, the fusion protein is a GST-NOVX fusion protein in which the NOVX sequences are fused to the C-terminus of the GST (glutathione S-transferase) sequences. Such fusion proteins can facilitate the purification of recombinant NOVX polypeptides.

In another embodiment, the fusion protein is an NOVX protein containing a heterologous signal sequence at its N-terminus. In certain host cells (e.g., mammalian host cells), expression and/or secretion of NOVX can be increased through use of a heterologous signal sequence.

In yet another embodiment, the fusion protein is an NOVX-immunoglobulin fusion protein in which the NOVX sequences are fused to sequences derived from a member of the immunoglobulin protein family. The NOVX-immunoglobulin fusion proteins of the invention can be incorporated into pharmaceutical compositions and administered to a subject to inhibit an interaction between an NOVX ligand and an NOVX protein on the surface of a cell, to thereby suppress NOVX-mediated signal transduction in vivo. The NOVX-immunoglobulin fusion proteins can be used to affect the bioavailability of an NOVX cognate ligand. Inhibition of the NOVX ligand/NOVX interaction may be useful therapeutically for both the treatment of proliferative and differentiative disorders, as well as modulating (e.g. promoting or inhibiting) cell survival. Moreover, the NOVX-immunoglobulin fusion proteins of the invention can be used as immunogens to produce anti-NOVX antibodies in a subject, to purify NOVX ligands, and in screening assays to identify molecules that inhibit the interaction of NOVX with an NOVX ligand.

An NOVX chimeric or fusion protein of the invention can be produced by standard recombinant DNA techniques. For example, DNA fragments coding for the different polypeptide sequences are ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel, et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). An NOVX-encoding nucleic acid can be cloned into such an expression vector such that the fusion moiety is linked in-frame to the NOVX protein.

NOVX Agonists and Antagonists

The invention also pertains to variants of the NOVX proteins that function as either NOVX agonists (i.e., mimetics) or as NOVX antagonists. Variants of the NOVX protein can be generated by mutagenesis (e.g., discrete point mutation or truncation of the NOVX protein). An agonist of the NOVX protein can retain substantially the same, or a subset of, the biological activities of the naturally occurring form of the NOVX protein. An antagonist of the NOVX protein can inhibit one or more of the activities of the naturally occurring form of the NOVX protein by, for example, competitively binding to a downstream or upstream member of a cellular signaling cascade which includes the NOVX protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the NOVX proteins.

Variants of the NOVX proteins that function as either NOVX agonists (i.e., mimetics) or as NOVX antagonists can be identified by screening combinatorial libraries of mutants (e.g., truncation mutants) of the NOVX proteins for NOVX protein agonist or antagonist activity. In one embodiment, a variegated library of NOVX variants is generated by combinatorial mutagenesis at the nucleic acid level and is encoded by a variegated gene library. A variegated library of NOVX variants can be produced by, for example, enzymatically ligating a mixture of synthetic oligonucleotides into gene sequences such that a degenerate set of potential NOVX sequences is expressible as individual polypeptides, or alternatively, as a set of larger fusion proteins (e.g., for phage display) containing the set of NOVX sequences therein. There are a variety of methods which can be used to produce libraries of potential NOVX variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential NOVX sequences. Methods for synthesizing degenerate oligonucleotides are well-known within the art. See, e.g., Narang, 1983. *Tetrahedron* 39: 3; Itakura, et al., 1984. *Annu. Rev. Biochem.* 53: 323; Itakura, et al., 1984. *Science* 198: 1056; Ike, et al., 1983. *Nucl. Acids Res.* 11: 477.

Polypeptide Libraries

In addition, libraries of fragments of the NOVX protein coding sequences can be used to generate a variegated population of NOVX fragments for screening and subsequent selection of variants of an NOVX protein. In one embodiment, a library of coding sequence fragments can be generated by treating a double stranded PCR fragment of an NOVX coding sequence with a nuclease under conditions wherein nicking occurs only about once per molecule, denaturing the double stranded DNA, renaturing the DNA to form double-stranded DNA that can include sense/antisense pairs from different nicked products, removing single stranded portions from reformed duplexes by treatment with $S_1$ nuclease, and ligating the resulting fragment library into an expression vector. By this method, expression libraries can be derived which encodes N-terminal and internal fragments of various sizes of the NOVX proteins.

Various techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of NOVX proteins. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify NOVX variants. See, e.g., Arkin and Yourvan, 1992. *Proc. Natl. Acad. Sci. USA* 89: 7811–7815; Delgrave, et al., 1993. *Protein Engineering* 6:327–331.

Anti-NOVX Antibodies

Also included in the invention are antibodies to NOVX proteins, or fragments of NOVX proteins. The term "antibody" as used herein refers to immunoglobulin molecules and immunologically active portions of immunoglobulin (Ig) molecules, i.e., molecules that contain an antigen binding site that specifically binds (immunoreacts with) an antigen. Such antibodies include, but are not limited to, polyclonal, monoclonal, chimeric, single chain, $F_{ab}$, $F_{ab'}$, and $F_{(ab')2}$ fragments, and an $F_{ab}$ expression library. In general, an antibody molecule obtained from humans relates to any of the classes IgG, IgM, IgA, IgE and IgD, which differ from one another by the nature of the heavy chain present in the molecule. Certain classes have subclasses as well, such as $IgG_1$, $IgG_2$, and others. Furthermore, in humans, the light chain may be a kappa chain or a lambda chain. Reference herein to antibodies includes a reference to all such classes, subclasses and types of human antibody species.

An isolated NOVX-related protein of the invention may be intended to serve as an antigen, or a portion or fragment thereof, and additionally can be used as an immunogen to generate antibodies that immunospecifically bind the antigen, using standard techniques for polyclonal and monoclonal antibody preparation. The full-length protein can be used or, alternatively, the invention provides antigenic peptide fragments of the antigen for use as immunogens. An antigenic peptide fragment comprises at least 6 amino acid residues of the amino acid sequence of the full length protein and encompasses an epitope thereof such that an antibody raised against the peptide forms a specific immune complex with the full length protein or with any fragment that contains the epitope. Preferably, the antigenic peptide comprises at least 10 amino acid residues, or at least 15 amino acid residues, or at least 20 amino acid residues, or at least 30 amino acid residues. Preferred epitopes encompassed by the antigenic peptide are regions of the protein that are located on its surface; commonly these are hydrophilic regions.

In certain embodiments of the invention, at least one epitope encompassed by the antigenic peptide is a region of NOVX-related protein that is located on the surface of the protein, e.g., a hydrophilic region. A hydrophobicity analysis of the human NOVX-related protein sequence will indicate which regions of a NOVX-related protein are particularly hydrophilic and, therefore, are likely to encode surface residues useful for targeting antibody production. As a means for targeting antibody production, hydropathy plots showing regions of hydrophilicity and hydrophobicity may be generated by any method well known in the art, including, for example, the Kyte Doolittle or the Hopp Woods methods, either with or without Fourier transformation. See, e.g., Hopp and Woods, 1981, *Proc. Nat. Acad. Sci. USA* 78: 3824–3828; Kyte and Doolittle 1982, *J. Mol. Biol.* 157: 105–142, each of which is incorporated herein by reference in its entirety. Antibodies that are specific for one or more domains within an antigenic protein, or derivatives, fragments, analogs or homologs thereof, are also provided herein.

A protein of the invention, or a derivative, fragment, analog, homolog or ortholog thereof, may be utilized as an immunogen in the generation of antibodies that immunospecifically bind these protein components.

Various procedures known within the art may be used for the production of polyclonal or monoclonal antibodies directed against a protein of the invention, or against derivatives, fragments, analogs homologs or orthologs thereof (see, for example, Antibodies: A Laboratory Manual, Harlow and Lane, 1988, Cold Spring Harbor Laboratory Press, Cold Spring Harbor, N.Y., incorporated herein by reference). Some of these antibodies are discussed below.

Polyclonal Antibodies

For the production of polyclonal antibodies, various suitable host animals (e.g., rabbit, goat, mouse or other mammal) may be immunized by one or more injections with the native protein, a synthetic variant thereof, or a derivative of the foregoing. An appropriate immunogenic preparation can contain, for example, the naturally occurring immunogenic protein, a chemically synthesized polypeptide representing the immunogenic protein, or a recombinantly expressed immunogenic protein. Furthermore, the protein may be conjugated to a second protein known to be immunogenic in the mammal being immunized. Examples of such immunogenic proteins include but are not limited to keyhole limpet hemocyanin, serum albumin, bovine thyroglobulin, and soybean trypsin inhibitor. The preparation can further include an adjuvant. Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), adjuvants usable in humans such as Bacille Calmette-Guerin and Corynebacterium parvum, or similar immunostimulatory agents. Additional examples of adjuvants which can be employed include MPL-TDM adjuvant (monophosphoryl Lipid A, synthetic trehalose dicorynomycolate).

The polyclonal antibody molecules directed against the immunogenic protein can be isolated from the mammal (e.g., from the blood) and further purified by well known techniques, such as affinity chromatography using protein A or protein G, which provide primarily the IgG fraction of immune serum. Subsequently, or alternatively, the specific antigen which is the target of the immunoglobulin sought, or an epitope thereof, may be immobilized on a column to purify the immune specific antibody by immunoaffinity chromatography. Purification of immunoglobulins is discussed, for example, by D. Wilkinson (The Scientist, published by The Scientist, Inc., Philadelphia Pa., Vol. 14, No. 8 (Apr. 17, 2000), pp. 25–28).

Monoclonal Antibodies

The term "monoclonal antibody" (MAb) or "monoclonal antibody composition", as used herein, refers to a population of antibody molecules that contain only one molecular species of antibody molecule consisting of a unique light chain gene product and a unique heavy chain gene product. In particular, the complementarity determining regions (CDRs) of the monoclonal antibody are identical in all the molecules of the population. MAbs thus contain an antigen binding site capable of immunoreacting with a particular epitope of the antigen characterized by a unique binding affinity for it.

Monoclonal antibodies can be prepared using hybridoma methods, such as those described by Kohler and Milstein, Nature, 256:495 (1975). In a hybridoma method, a mouse, hamster, or other appropriate host animal, is typically immunized with an immunizing agent to elicit lymphocytes that produce or are capable of producing antibodies that will specifically bind to the immunizing agent. Alternatively, the lymphocytes can be immunized in vitro.

The immunizing agent will typically include the protein antigen, a fragment thereof or a fusion protein thereof. Generally, either peripheral blood lymphocytes are used if cells of human origin are desired, or spleen cells or lymph node cells are used if non-human mammalian sources are desired. The lymphocytes are then fused with an immortalized cell line using a suitable fusing agent, such as polyethylene glycol, to form a hybridoma cell (Goding, MONOCLONAL ANTIBODIES: PRINCIPLES AND PRACTICE, Academic Press, (1986) pp. 59–103). Immortalized cell lines are usually transformed mammalian cells, particularly myeloma cells of rodent, bovine and human origin. Usually, rat or mouse myeloma cell lines are employed. The hybridoma cells can be cultured in a suitable culture medium that preferably contains one or more substances that inhibit the growth or survival of the unfused, immortalized cells. For example, if the parental cells lack the enzyme hypoxanthine guanine phosphoribosyl transferase (HGPRT or HPRT), the culture medium for the hybridomas typically will include hypoxanthine, aminopterin, and thymidine ("HAT medium"), which substances prevent the growth of HGPRT-deficient cells.

Preferred immortalized cell lines are those that fuse efficiently, support stable high level expression of antibody by the selected antibody-producing cells, and are sensitive to a medium such as HAT medium. More preferred immortalized cell lines are murine myeloma lines, which can be obtained, for instance, from the Salk Institute Cell Distribution Center, San Diego, Calif. and the American Type Culture Collection, Manassas, Va. Human myeloma and mouse-human heteromyeloma cell lines also have been described for the production of human monoclonal antibodies (Kozbor, J. Immunol., 133:3001 (1984); Brodeur et al., MONOCLONAL ANTIBODY PRODUCTION TECHNIQUES AND APPLICATIONS, Marcel Dekker, Inc., New York, (1987) pp. 51–63).

The culture medium in which the hybridoma cells are cultured can then be assayed for the presence of monoclonal antibodies directed against the antigen. Preferably, the binding specificity of monoclonal antibodies produced by the hybridoma cells is determined by immunoprecipitation or by an in vitro binding assay, such as radioimmunoassay (RIA) or enzyme-linked immunoabsorbent assay (ELISA). Such techniques and assays are known in the art. The binding affinity of the monoclonal antibody can, for example, be determined by the Scatchard analysis of Munson and Pollard, Anal. Biochem., 107:220 (1980). Preferably, antibodies having a high degree of specificity and a high binding affinity for the target antigen are isolated.

After the desired hybridoma cells are identified, the clones can be subcloned by limiting dilution procedures and grown by standard methods. Suitable culture media for this purpose include, for example, Dulbecco's Modified Eagle's Medium and RPMI-1640 medium. Alternatively, the hybridoma cells can be grown in vivo as ascites in a mammal.

The monoclonal antibodies secreted by the subclones can be isolated or purified from the culture medium or ascites fluid by conventional immunoglobulin purification procedures such as, for example, protein A-Sepharose, hydroxylapatite chromatography, gel electrophoresis, dialysis, or affinity chromatography.

The monoclonal antibodies can also be made by recombinant DNA methods, such as those described in U.S. Pat. No. 4,816,567. DNA encoding the monoclonal antibodies of the invention can be readily isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA can be placed into expression vectors, which are then transfected into host cells such as simian COS cells, Chinese hamster ovary (CHO) cells, or myeloma cells that do not otherwise produce immunoglobulin protein, to obtain the synthesis of monoclonal antibodies in the recombinant host cells. The DNA also can be modified, for example, by substituting the coding sequence for human heavy and light chain constant domains in place of the homologous murine sequences (U.S. Pat. No. 4,816,567; Morrison, Nature 368, 812–13 (1994)) or by covalently joining to the immunoglobulin coding sequence all or part of the coding sequence for a non-immunoglobulin polypeptide. Such a non-immunoglobulin polypeptide can be substituted for the constant domains of an antibody of the invention, or can be substituted for the variable domains of one antigen-combining site of an antibody of the invention to create a chimeric bivalent antibody.

Humanized Antibodies

The antibodies directed against the protein antigens of the invention can further comprise humanized antibodies or human antibodies. These antibodies are suitable for administration to humans without engendering an immune response by the human against the administered immunoglobulin. Humanized forms of antibodies are chimeric immunoglobulins, immunoglobulin chains or fragments thereof (such as Fv, Fab, Fab', F(ab')$_2$ or other antigen-binding subsequences of antibodies) that are principally comprised of the sequence of a human immunoglobulin, and contain minimal sequence derived from a non-human immunoglobulin. Humanization can be performed following the method of Winter and co-workers (Jones et al., Nature, 321:522–525 (1986); Riechmann et al., Nature, 332:323–327 (1988); Verhoeyen et al., Science, 239:1534–1536 (1988)), by substituting rodent CDRs or CDR sequences for the corresponding sequences of a human antibody. (See also U.S. Pat. No. 5,225,539.) In some instances, Fv framework residues of the human immunoglobulin are replaced by corresponding non-human residues. Humanized antibodies can also comprise residues which are found neither in the recipient antibody nor in the imported CDR or framework sequences. In general, the humanized antibody will comprise substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally also will comprise at least a portion of an immunoglobulin constant region (Fc), typically that of a human immunoglobulin (Jones et al., 1986; Riechmann et al., 1988; and Presta, *Curr. Op. Struct. Biol.*, 2:593–596 (1992)).

Human Antibodies

Fully human antibodies relate to antibody molecules in which essentially the entire sequences of both the light chain and the heavy chain, including the CDRs, arise from human genes. Such antibodies are termed "human antibodies", or "fully human antibodies" herein. Human monoclonal antibodies can be prepared by the trioma technique; the human B-cell hybridoma technique (see Kozbor, et al., 1983 Immunol Today 4: 72) and the EBV hybridoma technique to produce human monoclonal antibodies (see Cole, et al., 1985 In: MONOCLONAL ANTIBODIES AND CANCER THERAPY, Alan R. Liss, Inc., pp. 77–96). Human monoclonal antibodies may be utilized in the practice of the present invention and may be produced by using human hybridomas (see Cote, et al., 1983. Proc Natl Acad Sci USA 80: 2026–2030) or by transforming human B-cells with Epstein Barr Virus in vitro (see Cole, et al., 1985 In: MONOCLONAL ANTIBODIES AND CANCER THERAPY, Alan R. Liss, Inc., pp. 77–96).

In addition, human antibodies can also be produced using additional techniques, including phage display libraries (Hoogenboom and Winter, *J. Mol. Biol.*, 227:381 (1991); Marks et al., *J. Mol. Biol.*, 222:581 (1991)). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and in Marks et al. (*Bio/Technology* 10, 779–783 (1992)); Lonberg et al. (*Nature* 368 856–859 (1994)); Morrison (*Nature* 368, 812–13 (1994)); Fishwild et al,(*Nature Biotechnology* 14, 845–51 (1996)); Neuberger (*Nature Biotechnology* 14, 826 (1996)); and Lonberg and Huszar (*Intern. Rev. Immunol.* 13 65–93 (1995)).

Human antibodies may additionally be produced using transgenic nonhuman animals which are modified so as to produce fully human antibodies rather than the animal's endogenous antibodies in response to challenge by an antigen. (See PCT publication WO94/02602). The endogenous genes encoding the heavy and light immunoglobulin chains in the nonhuman host have been incapacitated, and active loci encoding human heavy and light chain immunoglobulins are inserted into the host's genome. The human genes are incorporated, for example, using yeast artificial chromosomes containing the requisite human DNA segments. An animal which provides all the desired modifications is then obtained as progeny by crossbreeding intermediate transgenic animals containing fewer than the full complement of the modifications. The preferred embodiment of such a nonhuman animal is a mouse, and is termed the Xenomouse™ as disclosed in PCT publications WO 96/33735 and WO 96/34096. This animal produces B cells which secrete fully human immunoglobulins. The antibodies can be obtained directly from the animal after immunization with an immunogen of interest, as, for example, a preparation of a polyclonal antibody, or alternatively from immortalized B cells derived from the animal, such as hybridomas producing monoclonal antibodies. Additionally, the genes encoding the immunoglobulins with human variable regions can be recovered and expressed to obtain the antibodies directly, or can be further modified to obtain analogs of antibodies such as, for example, single chain Fv molecules.

An example of a method of producing a nonhuman host, exemplified as a mouse, lacking expression of an endogenous immunoglobulin heavy chain is disclosed in U.S. Pat. No. 5,939,598. It can be obtained by a method including deleting the J segment genes from at least one endogenous heavy chain locus in an embryonic stem cell to prevent rearrangement of the locus and to prevent formation of a transcript of a rearranged immunoglobulin heavy chain locus, the deletion being effected by a targeting vector containing a gene encoding a selectable marker; and producing from the embryonic stem cell a transgenic mouse whose somatic and germ cells contain the gene encoding the selectable marker.

A method for producing an antibody of interest, such as a human antibody, is disclosed in U.S. Pat. No. 5,916,771. It includes introducing an expression vector that contains a nucleotide sequence encoding a heavy chain into one mammalian host cell in culture, introducing an expression vector containing a nucleotide sequence encoding a light chain into another mammalian host cell, and fusing the two cells to form a hybrid cell. The hybrid cell expresses an antibody containing the heavy chain and the light chain.

In a further improvement on this procedure, a method for identifying a clinically relevant epitope on an immunogen, and a correlative method for selecting an antibody that binds immunospecifically to the relevant epitope with high affinity, are disclosed in PCT publication WO 99/53049.

$F_{ab}$ Fragments and Single Chain Antibodies

According to the invention, techniques can be adapted for the production of single-chain antibodies specific to an antigenic protein of the invention (see e.g., U.S. Pat. No. 4,946,778). In addition, methods can be adapted for the construction of $F_{ab}$ expression libraries (see e.g., Huse, et al., 1989 Science 246: 1275–1281) to allow rapid and effective identification of monoclonal $F_{ab}$ fragments with the desired specificity for a protein or derivatives, fragments, analogs or homologs thereof. Antibody fragments that contain the idiotypes to a protein antigen may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')}2$ fragment; (iii) an $F_{ab}$ fragment generated by the treatment of the antibody molecule with papain and a reducing agent and (iv) $F_v$ fragments.

Bispecific Antibodies

Bispecific antibodies are monoclonal, preferably human or humanized, antibodies that have binding specificities for at least two different antigens. In the present case, one of the binding specificities is for an antigenic protein of the invention. The second binding target is any other antigen, and advantageously is a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, *Nature,* 305:537–539 (1983)). Because of the random assortment of immunoglobulin heavy and light chains, these hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829, published 13 May 1993, and in Trauneckeretal., 1991 *EMBO J.,* 10:3655–3659.

Antibody variable domains with the desired binding specificities (antibody-antigen combining sites) can be fused to immunoglobulin constant domain sequences. The fusion preferably is with an immunoglobulin heavy-chain constant domain, comprising at least part of the hinge, CH2, and CH3 regions. It is preferred to have the first heavy-chain constant region (CH1) containing the site necessary for light-chain binding present in at least one of the fusions. DNAs encoding the immunoglobulin heavy-chain fusions and, if desired, the immunoglobulin light chain, are inserted into separate expression vectors, and are co-transfected into a suitable host organism. For further details of generating bispecific antibodies see, for example, Suresh et al., *Methods in Enzymology,* 121:210 (1986).

According to another approach described in WO 96/27011, the interface between a pair of antibody molecules can be engineered to maximize the percentage of heterodimers which are recovered from recombinant cell culture. The preferred interface comprises at least a part of the CH3 region of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies can be prepared as full length antibodies or antibody fragments (e.g. F(ab')$_2$ bispecific antibodies). Techniques for generating bispecific antibodies from antibody fragments have been described in the literature. For example, bispecific antibodies can be prepared using chemical linkage. Brennan et al., *Science* 229:81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Additionally, Fab' fragments can be directly recovered from *E. coli* and chemically coupled to form bispecific antibodies. Shalaby et al., *J. Exp. Med.* 175:217–225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., *J. Immunol.* 148(5):1547–1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., *Proc. Natl. Acad. Sci. USA* 90:6444–6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See, Gruber et al., *J. Immunol.* 152:5368 (1994).

Antibodies with more than two valencies are contemplated. For example, trispecific antibodies can be prepared. Tutt et al., *J. Immunol.* 147:60 (1991).

Exemplary bispecific antibodies can bind to two different epitopes, at least one of which originates in the protein antigen of the invention. Alternatively, an anti-antigenic arm of an immunoglobulin molecule can be combined with an arm which binds to a triggering molecule on a leukocyte such as a T-cell receptor molecule (e.g. CD2, CD3, CD28, or B7), or Fc receptors for IgG (FcγR), such as FcγRI (CD64), FcγRII (CD32) and FcγRIII (CD16) so as to focus cellular defense mechanisms to the cell expressing the particular antigen. Bispecific antibodies can also be used to direct cytotoxic agents to cells which express a particular antigen. These antibodies possess an antigen-binding arm and an arm which binds a cytotoxic agent or a radionuclide chelator, such as EOTUBE, DPTA, DOTA, or TETA. Another bispecific antibody of interest binds the protein antigen described herein and further binds tissue factor (TF).

Heteroconjugate Antibodies

Heteroconjugate antibodies are also within the scope of the present invention. Heteroconjugate antibodies are composed of two covalently joined antibodies. Such antibodies have, for example, been proposed to target immune system cells to unwanted cells (U.S. Pat. No. 4,676,980), and for treatment of HIV infection (WO 91/00360; WO 92/200373; EP 03089). It is contemplated that the antibodies can be prepared in vitro using known methods in synthetic protein chemistry, including those involving crosslinking agents. For example, immunotoxins can be constructed using a disulfide exchange reaction or by forming a thioether bond. Examples of suitable reagents for this purpose include iminothiolate and methyl-4-mercaptobutyrimidate and those disclosed, for example, in U.S. Pat. No. 4,676,980.

Effector Function Engineering

It can be desirable to modify the antibody of the invention with respect to effector function, so as to enhance, e.g., the effectiveness of the antibody in treating cancer. For example, cysteine residue(s) can be introduced into the Fc region, thereby allowing interchain disulfide bond formation in this region. The homodimeric antibody thus generated can have improved internalization capability and/or increased complement-mediated cell killing and antibody-dependent cellular cytotoxicity (ADCC). See Caron et al., J. Exp Med., 176: 1191–1195 (1992) and Shopes, J. Immunol., 148: 2918–2922 (1992). Homodimeric antibodies with enhanced anti-tumor activity can also be prepared using heterobifunctional cross-linkers as described in Wolff et al. Cancer Research, 53: 2560–2565 (1993). Alternatively, an antibody can be engineered that has dual Fc regions and can thereby have enhanced complement lysis and ADCC capabilities. See Stevenson et al., Anti-Cancer Drug Design, 3: 219–230 (1989).

Immunoconjugates

The invention also pertains to immunoconjugates comprising an antibody conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate).

Chemotherapeutic agents useful in the generation of such immunoconjugates have been described above. Enzymatically active toxins and fragments thereof that can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin, and the tricothecenes. A variety of radionuclides are available for the production of radioconjugated antibodies. Examples include $^{212}$Bi, $^{131}$I, $^{131}$In, $^{90}$Y, and $^{186}$Re.

Conjugates of the antibody and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis(p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., Science, 238: 1098 (1987). Carbon-14-labeled 1-isothiocyanatobenzyl-3-methyldiethylene triaminepentaacetic acid (MX-DTPA) is an exemplary chelating agent for conjugation of radionucleotide to the antibody. See WO94/11026.

In another embodiment, the antibody can be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g., avidin) that is in turn conjugated to a cytotoxic agent.

In one embodiment, methods for the screening of antibodies that possess the desired specificity include, but are not limited to, enzyme-linked immunosorbent assay (ELISA) and other immunologically-mediated techniques known within the art. In a specific embodiment, selection of antibodies that are specific to a particular domain of an NOVX protein is facilitated by generation of hybridomas that bind to the fragment of an NOVX protein possessing such a domain. Thus, antibodies that are specific for a desired domain within an NOVX protein, or derivatives, fragments, analogs or homologs thereof, are also provided herein.

Anti-NOVX antibodies may be used in methods known within the art relating to the localization and/or quantitation of an NOVX protein (e.g., for use in measuring levels of the NOVX protein within appropriate physiological samples, for use in diagnostic methods, for use in imaging the protein, and the like). In a given embodiment, antibodies for NOVX proteins, or derivatives, fragments, analogs or homologs thereof, that contain the antibody derived binding domain, are utilized as pharmacologically-active compounds (hereinafter "Therapeutics").

An anti-NOVX antibody (e.g., monoclonal antibody) can be used to isolate an NOVX polypeptide by standard techniques, such as affinity chromatography or immunoprecipitation. An anti-NOVX antibody can facilitate the purification of natural NOVX polypeptide from cells and of recombinantly-produced NOVX polypeptide expressed in host cells. Moreover, an anti-NOVX antibody can be used to detect NOVX protein (e.g., in a cellular lysate or cell supernatant) in order to evaluate the abundance and pattern of expression of the NOVX protein. Anti-NOVX antibodies can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

NOVX Recombinant Expression Vectors and Host Cells

Another aspect of the invention pertains to vectors, preferably expression vectors, containing a nucleic acid encoding an NOVX protein, or derivatives, fragments, analogs or homologs thereof. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, that is operatively-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell).

The term "regulatory sequence" is intended to includes promoters, enhancers and other expression control elements (e.g., polyadenylation signals). Such regulatory sequences are described, for example, in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., NOVX proteins, mutant forms of NOVX proteins, fusion proteins, etc.).

The recombinant expression vectors of the invention can be designed for expression of NOVX proteins in prokaryotic or eukaryotic cells. For example, NOVX proteins can be expressed in bacterial cells such as *Escherichia coli,* insect cells (using baculovirus expression vectors) yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988. *Gene* 67: 31–40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301–315) and pET 11d (Studier et al., GENE EXPRESSION TECHNOLOGY: METHODS IN ENZYMOLOGY 185, Academic Press, San Diego, Calif. (1990) 60–89).

One strategy to maximize recombinant protein expression in *E. coli* is to express the protein in a host bacteria with an impaired capacity to proteolytically cleave the recombinant protein. See, e.g., Gottesman, GENE EXPRESSION TECHNOLOGY: METHODS IN ENZYMOLOGY 185, Academic Press, San Diego, Calif. (1990) 119–128. Another strategy is to alter the nucleic acid sequence of the nucleic acid to be inserted into an expression vector so that the individual codons for each amino acid are those preferentially utilized in *E. coli* (see, e.g., Wada, et al., 1992. *Nucl. Acids Res.* 20: 2111–2118). Such alteration of nucleic acid sequences of the invention can be carried out by standard DNA synthesis techniques.

In another embodiment, the NOVX expression vector is a yeast expression vector. Examples of vectors for expression in yeast *Saccharomyces cerivisae* include pYepSec1 (Baldari, et al., 1987. *EMBO J.* 6: 229–234), pMFa (Kurjan and Herskowitz, 1982. *Cell* 30: 933–943), pJRY88 (Schultz et al., 1987. *Gene* 54: 113–123), pYES2 (Invitrogen Corporation, San Diego, Calif.), and picZ (InVitrogen Corp, San Diego, Calif.).

Alternatively, NOVX can be expressed in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156–2165) and the pVL series (Lucklow and Summers, 1989. *Virology* 170: 31–39).

In yet another embodiment, a nucleic acid of the invention is expressed in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187–195). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268–277), lymphoid-specific promoters (Calame and Eaton, 1988. *Adv. Immunol.* 43: 235–275), in particular promoters of T cell receptors (Winoto and Baltimore, 1989. *EMBO J.* 8: 729–733) and immunoglobulins (Banerji, et al., 1983. *Cell* 33: 729–740; Queen and Baltimore, 1983. Cell 33: 741–748), neuron-specific promoters (e.g., the neurofilament promoter; Byrne and Ruddle, 1989. *Proc. Natl. Acad. Sci. USA* 86: 5473–5477), pancreas-specific promoters (Edlund, et al., 1985. *Science* 230: 912–916), and mammary gland-specific promoters (e.g., milk whey promoter; U.S. Pat. No. 4,873, 316 and European Application Publication No. 264,166). Developmentally-regulated promoters are also encompassed, e.g., the murine hox promoters (Kessel and Gruss, 1990. *Science* 249: 374–379) and the α-fetoprotein promoter (Campes and Tilghman, 1989. *Genes Dev.* 3: 537–546).

The invention further provides a recombinant expression vector comprising a DNA molecule of the invention cloned into the expression vector in an antisense orientation. That is, the DNA molecule is operatively-linked to a regulatory sequence in a manner that allows for expression (by transcription of the DNA molecule) of an RNA molecule that is antisense to NOVX mRNA. Regulatory sequences operatively linked to a nucleic acid cloned in the antisense orientation can be chosen that direct the continuous expression of the antisense RNA molecule in a variety of cell types, for instance viral promoters and/or enhancers, or regulatory sequences can be chosen that direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see, e.g., Weintraub, et al., "Antisense RNA as a molecular tool for genetic analysis," *Reviews-Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, NOVX protein can be expressed in bacterial cells such as *E. coli*, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding NOVX or can be introduced on a separate vector. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce (i.e., express) NOVX protein. Accordingly, the invention further provides methods for producing NOVX protein using the host cells of the invention. In one embodiment, the method comprises culturing the host cell of invention (into which a recombinant expression vector encoding NOVX protein has been introduced) in a suitable medium such that NOVX protein is produced. In another embodiment, the method further comprises isolating NOVX protein from the medium or the host cell.

Transgenic NOVX Animals

The host cells of the invention can also be used to produce non-human transgenic animals. For example, in one embodiment, a host cell of the invention is a fertilized oocyte or an embryonic stem cell into which NOVX protein-coding sequences have been introduced. Such host cells can then be used to create non-human transgenic animals in which exogenous NOVX sequences have been introduced into their genome or homologous recombinant animals in which endogenous NOVX sequences have been altered. Such animals are useful for studying the function and/or activity of NOVX protein and for identifying and/or evaluating modulators of NOVX protein activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA that is integrated into the genome of a cell from which a transgenic animal develops and that remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous NOVX gene has been altered by homologous recombination between the endogenous gene and an exogenous DNA molecule introduced into a cell of the animal, e.g., an embryonic cell of the animal, prior to development of the animal.

A transgenic animal of the invention can be created by introducing NOVX-encoding nucleic acid into the male pronuclei of a fertilized oocyte (e.g., by microinjection, retroviral infection) and allowing the oocyte to develop in a pseudopregnant female foster animal. The human NOVX cDNA sequences SEQ ID NOS: 1, 3, 5, 7, 9, 11, 13, 15, 17, 19, 21, 23, 25, 27, 29, 31, 33, 35, 37, 39, 41, 43, 45, 47, 49, and 51 can be introduced as a transgene into the genome of a non-human animal. Alternatively, a non-human homologue of the human NOVX gene, such as a mouse NOVX gene, can be isolated based on hybridization to the human NOVX cDNA (described further supra) and used as a transgene. Intronic sequences and polyadenylation signals can also be included in the transgene to increase the efficiency of expression of the transgene. A tissue-specific regulatory sequence(s) can be operably-linked to the NOVX transgene to direct expression of NOVX protein to particular cells. Methods for generating transgenic animals via embryo manipulation and microinjection, particularly animals such as mice, have become conventional in the art and are described, for example, in U.S. Pat. Nos. 4,736,866; 4,870,009; and 4,873,191; and Hogan, 1986. In: MANIPULATING THE MOUSE EMBRYO, Cold Spring Harbor Laboratory Press, Cold Spring Harbor, N.Y. Similar methods are used for production of other transgenic animals. A transgenic founder animal can be identified based upon the presence of the NOVX transgene in its genome and/or expression of NOVX mRNA in tissues or cells of the animals. A transgenic founder animal can then be used to breed additional animals carrying the transgene. Moreover, transgenic animals carrying a transgene-encoding NOVX protein can further be bred to other transgenic animals carrying other transgenes.

To create a homologous recombinant animal, a vector is prepared which contains at least a portion of an NOVX gene into which a deletion, addition or substitution has been introduced to thereby alter, e.g., functionally disrupt, the NOVX gene. The NOVX gene can be a human gene (e.g., the cDNA of SEQ ID NOS: 1, 3, 5, 7, 9, 11, 13, 15, 17, 19, 21, 23, 25, 27, 29, 31, 33, 35, 37, 39, 41, 43, 45, 47, 49, and 51), but more preferably, is a non-human homologue of a human NOVX gene. For example, a mouse homologue of human NOVX gene of SEQ ID NOS: 1, 3, 5, 7, 9, 11, 13, 15, 17, 19, 21, 23, 25, 27, 29, 31, 33, 35, 37, 39, 41, 43, 45, 47, 49, and 51 can be used to construct a homologous recombination vector suitable for altering an endogenous NOVX gene in the mouse genome. In one embodiment, the vector is designed such that, upon homologous recombination, the endogenous NOVX gene is functionally disrupted (i.e., no longer encodes a functional protein; also referred to as a "knock out" vector).

Alternatively, the vector can be designed such that, upon homologous recombination, the endogenous NOVX gene is mutated or otherwise altered but still encodes functional protein (e.g., the upstream regulatory region can be altered to thereby alter the expression of the endogenous NOVX protein). In the homologous recombination vector, the altered portion of the NOVX gene is flanked at its 5'- and 3'-termini by additional nucleic acid of the NOVX gene to allow for homologous recombination to occur between the exogenous NOVX gene carried by the vector and an endogenous NOVX gene in an embryonic stem cell. The additional flanking NOVX nucleic acid is of sufficient length for successful homologous recombination with the endogenous gene. Typically, several kilobases of flanking DNA (both at the 5'- and 3'-termini) are included in the vector. See, e.g., Thomas, et al., 1987. *Cell* 51: 503 for a description of homologous recombination vectors. The vector is ten introduced into an embryonic stem cell line (e.g., by electroporation) and cells in which the introduced NOVX gene has homologously-recombined with the endogenous NOVX gene are selected. See, e.g., Li, et al., 1992. *Cell* 69: 915.

The selected cells are then injected into a blastocyst of an animal (e.g., a mouse) to form aggregation chimeras. See, e.g., Bradley, 1987. In: TERATOCARCINOMAS AND EMBRYONIC STEM CELLS: A PRACTICAL APPROACH, Robertson, ed. IRL, Oxford, pp. 113–152. A chimeric embryo can then be implanted into a suitable pseudopregnant female foster animal and the embryo brought to term. Progeny harboring the homologously-recombined DNA in their germ cells can be used to breed animals in which all cells of the animal contain the homologously-recombined DNA by germline transmission of the transgene. Methods for constructing homologous recombination vectors and homologous recombinant animals are described further in Bradley, 1991. *Curr. Opin. Biotechnol.* 2: 823–829; PCT International Publication Nos.: WO 90/11354; WO 91/01140; WO 92/0968; and WO 93/04169.

In another embodiment, transgenic non-humans animals can be produced that contain selected systems that allow for regulated expression of the transgene. One example of such a system is the cre/loxP recombinase system of bacteriophage P1. For a description of the cre/loxP recombinase system, See, e.g., Lakso, et al., 1992. *Proc. Natl. Acad. Sci. USA* 89: 6232–6236. Another example of a recombinase system is the FLP recombinase system of *Saccharomyces cerevisiae*. See, O'Gorman, et al., 1991. *Science* 251:1351–1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, et al., 1997. *Nature* 385: 810–813. In brief, a cell (e.g., a somatic cell) from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell (e.g., the somatic cell) is isolated.

Pharmaceutical Compositions

The NOVX nucleic acid molecules, NOVX proteins, and anti-NOVX antibodies (also referred to herein as "active compounds") of the invention, and derivatives, fragments, analogs and homologs thereof, can be incorporated into pharmaceutical compositions suitable for administration. Such compositions typically comprise the nucleic acid molecule, protein, or antibody and a pharmaceutically acceptable carrier. As used herein, "pharmaceutically acceptable carrier" is intended to include any and all solvents, dispersion media, coatings, antibacterial and antifungal agents, isotonic and absorption delaying agents, and the like, compatible with pharmaceutical administration. Suitable carriers are described in the most recent edition of Remington's Pharmaceutical Sciences, a standard reference text in the field, which is incorporated herein by reference. Preferred examples of such carriers or diluents include, but are not limited to, water, saline, finger's solutions, dextrose solution, and 5% human serum albumin. Liposomes and non-aqueous vehicles such as fixed oils may also be used. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (i.e., topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid (EDTA); buffers such as acetates, citrates or phosphates, and agents for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., an NOVX protein or anti-NOVX antibody) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The nucleic acid molecules of the invention can be inserted into vectors and used as gene therapy vectors. Gene therapy vectors can be delivered to a subject by, for example, intravenous injection, local administration (see, e.g., U.S. Pat. No. 5,328,470) or by stereotactic injection (see, e.g., Chen, et al., 1994. *Proc. Natl. Acad. Sci. USA* 91: 3054–3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

The pharmaceutical compositions can be included in a container, pack, or dispenser together with instructions for administration.

Screening and Detection Methods

The isolated nucleic acid molecules of the invention can be used to express NOVX protein (e.g., via a recombinant expression vector in a host cell in gene therapy applications), to detect NOVX mRNA (e.g., in a biological sample) or a genetic lesion in an NOVX gene, and to modulate NOVX activity, as described further, below. In addition, the NOVX proteins can be used to screen drugs or compounds that modulate the NOVX protein activity or expression as well as to treat disorders characterized by insufficient or excessive production of NOVX protein or production of NOVX protein forms that have decreased or aberrant activity compared to NOVX wild-type protein (e.g.; diabetes (regulates insulin release); obesity (binds and transport lipids); metabolic disturbances associated with obesity, the metabolic syndrome X as well as anorexia and wasting disorders associated with chronic diseases and various cancers, and infectious disease(possesses anti-microbial activity) and the various dyslipidemias. In addition, the anti-NOVX antibodies of the invention can be used to detect and isolate NOVX proteins and modulate NOVX activity. In yet a further aspect, the invention can be used in methods to influence appetite, absorption of nutrients and the disposition of metabolic substrates in both a positive and negative fashion.

The invention further pertains to novel agents identified by the screening assays described herein and uses thereof for treatments as described, supra.

Screening Assays

The invention provides a method (also referred to herein as a "screening assay") for identifying modulators, i.e., candidate or test compounds or agents (e.g., peptides, peptidomimetics, small molecules or other drugs) that bind to NOVX proteins or have a stimulatory or inhibitory effect on, e.g., NOVX protein expression or NOVX protein activity. The invention also includes compounds identified in the screening assays described herein.

In one embodiment, the invention provides assays for screening candidate or test compounds which bind to or modulate the activity of the membrane-bound form of an NOVX protein or polypeptide or biologically-active portion thereof. The test compounds of the invention can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to peptide libraries, while the other four approaches are applicable to peptide, non-peptide oligomer or small molecule libraries of compounds. See, e.g., Lam, 1997. *Anticancer Drug Design* 12: 145.

A "small molecule" as used herein, is meant to refer to a composition that has a molecular weight of less than about 5 kD and most preferably less than about 4 kD. Small molecules can be, e.g., nucleic acids, peptides, polypeptides, peptidomimetics, carbohydrates, lipids or other organic or inorganic molecules. Libraries of chemical and/or biological mixtures, such as fungal, bacterial, or algal extracts, are known in the art and can be screened with any of the assays of the invention.

Examples of methods for the synthesis of molecular libraries can be found in the art, for example in: DeWitt, et al., 1993. *Proc. Natl. Acad. Sci. U.S.A.* 90: 6909; Erb, et al., 1994. *Proc. Natl. Acad. Sci. U.S.A.* 91: 11422; Zuckermann, et al., 1994. *J. Med. Chem.* 37: 2678; Cho, et al., 1993. *Science* 261: 1303; Carrell, et al., 1994. *Angew. Chem. Int. Ed. Engl.* 33: 2059; Carell, et al., 1994. *Angew. Chem. Int. Ed. Engl.* 33: 2061; and Gallop, et al., 1994. *J. Med. Chem.* 37: 1233.

Libraries of compounds may be presented in solution (e.g., Houghten, 1992. *Biotechniques* 13: 412–421), or on beads (Lam, 1991. *Nature* 354: 82–84), on chips (Fodor, 1993. Nature 364: 555–556), bacteria (Ladner, U.S. Pat. No. 5,223,409), spores (Ladner, U.S. Pat. No. 5,233,409), plasmids (Cull, et al., 1992. *Proc. Natl. Acad. Sci. USA* 89: 1865–1869) or on phage (Scott and Smith, 1990. *Science* 249: 386–390; Devlin, 1990. *Science* 249:404–406; Cwirla, et al., 1990. *Proc. Natl. Acad. Sci. U.S.A.* 87: 6378–6382; Felici, 1991. *J. Mol. Biol.* 222: 301–310; Ladner, U.S. Pat. No. 5,233,409.).

In one embodiment, an assay is a cell-based assay in which a cell which expresses a membrane-bound form of NOVX protein, or a biologically-active portion thereof, on the cell surface is contacted with a test compound and the ability of the test compound to bind to an NOVX protein determined. The cell, for example, can of mammalian origin or a yeast cell. Determining the ability of the test compound to bind to the NOVX protein can be accomplished, for example, by coupling the test compound with a radioisotope or enzymatic label such that binding of the test compound to the NOVX protein or biologically-active portion thereof can be determined by detecting the labeled compound in a complex. For example, test compounds can be labeled with $^{125}I$, $^{35}S$, $^{14}C$, or $^{3}H$, either directly or indirectly, and the radioisotope detected by direct counting of radioemission or by scintillation counting. Alternatively, test compounds can be enzymatically-labeled with, for example, horseradish peroxidase, alkaline phosphatase, or luciferase, and the enzymatic label detected by determination of conversion of an appropriate substrate to product. In one embodiment, the assay comprises contacting a cell which expresses a membrane-bound form of NOVX protein, or a biologically-active portion thereof, on the cell surface with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX protein or a biologically-active portion thereof as compared to the known compound.

In another embodiment, an assay is a cell-based assay comprising contacting a cell expressing a membrane-bound form of NOVX protein, or a biologically-active portion thereof, on the cell surface with a test compound and determining the ability of the test compound to modulate (e.g., stimulate or inhibit) the activity of the NOVX protein or biologically-active portion thereof. Determining the ability of the test compound to modulate the activity of NOVX or a biologically-active portion thereof can be accomplished, for example, by determining the ability of the NOVX protein to bind to or interact with an NOVX target molecule. As used herein, a "target molecule" is a molecule with which an NOVX protein binds or interacts in nature, for example, a molecule on the surface of a cell which expresses an NOVX interacting protein, a molecule on the surface of a second cell, a molecule in the extracellular milieu, a molecule associated with the internal surface of a cell membrane or a cytoplasmic molecule. An NOVX target molecule can be a non-NOVX molecule or an NOVX protein or polypeptide of the invention. In one embodiment, an NOVX target molecule is a component of a signal transduction pathway that facilitates transduction of an extracellular signal (e.g. a signal generated by binding of a compound to a membrane-bound NOVX molecule) through the cell membrane and into the cell. The target, for example, can be a second intercellular protein that has catalytic activity or a protein that facilitates the association of downstream signaling molecules with NOVX.

Determining the ability of the NOVX protein to bind to or interact with an NOVX target molecule can be accomplished by one of the methods described above for determining direct binding. In one embodiment, determining the ability of the NOVX protein to bind to or interact with an NOVX target molecule can be accomplished by determining the activity of the target molecule. For example, the activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an NOVX-responsive regulatory element operatively linked to a nucleic acid encoding a detectable marker, e.g., luciferase), or detecting a cellular response, for example, cell survival, cellular differentiation, or cell proliferation.

In yet another embodiment, an assay of the invention is a cell-free assay comprising contacting an NOVX protein or biologically-active portion thereof with a test compound and determining the ability of the test compound to bind to the NOVX protein or biologically-active portion thereof. Binding of the test compound to the NOVX protein can be determined either directly or indirectly as described above. In one such embodiment, the assay comprises contacting the NOVX protein or biologically-active portion thereof with a known compound which binds NOVX to form an assay mixture, contacting the assay mixture with a test compound, and determining the ability of the test compound to interact with an NOVX protein, wherein determining the ability of the test compound to interact with an NOVX protein comprises determining the ability of the test compound to preferentially bind to NOVX or biologically-active portion thereof as compared to the known compound.

In still another embodiment, an assay is a cell-free assay comprising contacting NOVX protein or biologically-active portion thereof with a test compound and determining the ability of the test compound to modulate (e.g. stimulate or inhibit) the activity of the NOVX protein or biologically-active portion thereof. Determining the ability of the test compound to modulate the activity of NOVX can be accomplished, for example, by determining the ability of the NOVX protein to bind to an NOVX target molecule by one of the methods described above for determining direct binding. In an alternative embodiment, determining the ability of the test compound to modulate the activity of NOVX protein can be accomplished by determining the ability of the NOVX protein further modulate an NOVX target molecule. For example, the catalytic/enzymatic activity of the target molecule on an appropriate substrate can be determined as described, supra.

In yet another embodiment, the cell-free assay comprises contacting the NOVX protein or biologically-active portion thereof with a known compound which binds NOVX protein to form an assay mixture, contacting the assay mixture with a test compound, and determining the ability of the test compound to interact with an NOVX protein, wherein determining the ability of the test compound to interact with an NOVX protein comprises determining the ability of the NOVX protein to preferentially bind to or modulate the activity of an NOVX target molecule.

The cell-free assays of the invention are amenable to use of both the soluble form or the membrane-bound form of NOVX protein. In the case of cell-free assays comprising the membrane-bound form of NOVX protein, it may be desirable to utilize a solubilizing agent such that the membrane-bound form of NOVX protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, N-dodecyl--N,N-dimethyl-3-ammonio-1-propane sulfonate, 3-(3-cholamidopropyl) dimethylamminiol-1-propane sulfonate (CHAPS), or 3-(3-cholamidopropyl) dimethylamminiol-2-hydroxy-1-propane sulfonate (CHAPSO).

In more than one embodiment of the above assay methods of the invention, it may be desirable to immobilize either NOVX protein or its target molecule to facilitate separation of complexed from uncomplexed forms of one or both of the proteins, as well as to accommodate automation of the assay. Binding of a test compound to NOVX protein, or interaction of NOVX protein with a target molecule in the presence and absence of a candidate compound, can be accomplished in any vessel suitable for containing the reactants. Examples of such vessels include microtiter plates, test tubes, and microcentrifuge tubes. In one embodiment, a fusion protein can be provided that adds a domain that allows one or both of the proteins to be bound to a matrix. For example, GST-NOVX fusion proteins or GST-target fusion proteins can be adsorbed onto glutathione sepharose beads (Sigma Chemical, St. Louis, Mo.) or glutathione derivatized microtiter plates, that are then combined with the test compound or the test compound and either the non-adsorbed target protein or NOVX protein, and the mixture is incubated under conditions conducive to complex formation (e.g., at physiological conditions for salt and pH). Following incubation, the beads or microtiter plate wells are washed to remove any unbound components, the matrix immobilized in the case of beads, complex determined either directly or indirectly, for example, as described, supra. Alternatively, the complexes can be dissociated from the matrix, and the level of NOVX protein binding or activity determined using standard techniques.

Other techniques for immobilizing proteins on matrices can also be used in the screening assays of the invention. For example, either the NOVX protein or its target molecule can be immobilized utilizing conjugation of biotin and streptavidin. Biotinylated NOVX protein or target molecules can be prepared from biotin-NHS (N-hydroxy-succinimide) using techniques well-known within the art (e.g., biotinylation kit, Pierce Chemicals, Rockford, Ill.), and immobilized in the wells of streptavidin-coated 96 well plates (Pierce Chemical). Alternatively, antibodies reactive with NOVX protein or target molecules, but which do not interfere with binding of the NOVX protein to its target molecule, can be derivatized to the wells of the plate, and unbound target or NOVX protein trapped in the wells by antibody conjugation. Methods for detecting such complexes, in addition to those described above for the GST-immobilized complexes, include immunodetection of complexes using antibodies reactive with the NOVX protein or target molecule, as well as enzyme-linked assays that rely on detecting an enzymatic activity associated with the NOVX protein or target molecule.

In another embodiment, modulators of NOVX protein expression are identified in a method wherein a cell is contacted with a candidate compound and the expression of NOVX mRNA or protein in the cell is determined. The level of expression of NOVX mRNA or protein in the presence of the candidate compound is compared to the level of expression of NOVX mRNA or protein in the absence of the candidate compound. The candidate compound can then be identified as a modulator of NOVX mRNA or protein expression based upon this comparison. For example, when expression of NOVX mRNA or protein is greater (i.e., statistically significantly greater) in the presence of the candidate compound than in its absence, the candidate compound is identified as a stimulator of NOVX mRNA or protein expression. Alternatively, when expression of NOVX mRNA or protein is less (statistically significantly less) in the presence of the candidate compound than in its absence, the candidate compound is identified as an inhibitor of NOVX mRNA or protein expression. The level of NOVX mRNA or protein expression in the cells can be determined by methods described herein for detecting NOVX mRNA or protein.

In yet another aspect of the invention, the NOVX proteins can be used as "bait proteins" in a two-hybrid assay or three hybrid assay (see, e.g., U.S. Pat. No. 5,283,317; Zervos, et al., 1993. *Cell* 72: 223–232; Madura, et al., 1993. *J. Biol. Chem.* 268: 12046–12054; Bartel, et al., 1993. *Biotechniques* 14: 920–924; Iwabuchi, et al., 1993. *Oncogene* 8: 1693–1696; and Brent WO 94/10300), to identify other proteins that bind to or interact with NOVX ("NOVX-binding proteins" or "NOVX-bp") and modulate NOVX activity. Such NOVX-binding proteins are also likely to be involved in the propagation of signals by the NOVX proteins as, for example, upstream or downstream elements of the NOVX pathway.

The two-hybrid system is based on the modular nature of most transcription factors, which consist of separable DNA-binding and activation domains. Briefly, the assay utilizes two different DNA constructs. In one construct, the gene that codes for NOVX is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an NOVX-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected and cell colonies containing the functional transcription factor can be isolated and used to obtain the cloned gene that encodes the protein which interacts with NOVX.

The invention further pertains to novel agents identified by the aforementioned screening assays and uses thereof for treatments as described herein.

Detection Assays

Portions or fragments of the cDNA sequences identified herein (and the corresponding complete gene sequences) can be used in numerous ways as polynucleotide reagents. By way of example, and not of limitation, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. Some of these applications are described in the subsections, below.

Chromosome Mapping

Once the sequence (or a portion of the sequence) of a gene has been isolated, this sequence can be used to map the location of the gene on a chromosome. This process is called chromosome mapping. Accordingly, portions or fragments of the NOVX sequences, SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or fragments or derivatives thereof, can be used to map the location of the NOVX genes, respectively, on a chromosome. The mapping of the NOVX sequences to chromosomes is an important first step in correlating these sequences with genes associated with disease.

Briefly, NOVX genes can be mapped to chromosomes by preparing PCR primers (preferably 15–25 bp in length) from the NOVX sequences. Computer analysis of the NOVX, sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the NOVX sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but in which human cells can, the one human chromosome that contains the gene encoding the needed enzyme will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. See, e.g., D'Eustachio, et al., 1983. *Science* 220: 919–924. Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the NOVX sequences to design oligonucleotide primers, sub-localization can be achieved with panels of fragments from specific chromosomes.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases, will suffice to get good results at a reasonable amount of time. For a review of this technique, see, Verma, et al., HUMAN CHROMOSOMES: A MANUAL OF BASIC TECHNIQUES (Pergamon Press, New York 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. Such data are found, e.g., in McKusick, MENDELIAN INHERITANCE IN MAN, available on-line through Johns Hopkins University Welch Medical Library). The relationship between genes and disease, mapped to the same chromosomal region, can then be identified through linkage analysis (co-inheritance of physically adjacent genes), described in, e.g., Egeland, et al., 1987. Nature, 325: 783–787.

Moreover, differences in the DNA sequences between individuals affected and unaffected with a disease associated with the NOVX gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing

The NOVX sequences of the invention can also be used to identify individuals from minute biological samples. In this technique, an individual's genomic DNA is digested with one or more restriction enzymes, and probed on a Southern blot to yield unique bands for identification. The sequences of the invention are useful as additional DNA markers for RFLP ("restriction fragment length polymorphisms," described in U.S. Pat. No. 5,272,057).

Furthermore, the sequences of the invention can be used to provide an alternative technique that determines the actual base-by-base DNA sequence of selected portions of an individual's genome. Thus, the NOVX sequences described herein can be used to prepare two PCR primers from the 5'- and 3'-termini of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the invention can be used to obtain such identification sequences from individuals and from tissue. The NOVX sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Much of the allelic variation is due to single nucleotide polymorphisms (SNPs), which include restriction fragment length polymorphisms (RFLPs).

Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences can comfortably provide positive individual identification with a panel of perhaps 10 to 1,000 primers that each yield a noncoding amplified sequence of 100 bases. If predicted coding sequences, such as those in SEQ ID NOS: 1, 3, 5, 7, 9, 11, 13, 15, 17, 19, 21, 23, 25, 27, 29, 31, 33, 35, 37, 39, 41, 43, 45, 47, 49, and 51 are used, a more appropriate number of primers for positive individual identification would be 500–2,000.

Predictive Medicine

The invention also pertains to the field of predictive medicine in which diagnostic assays, prognostic assays, pharmacogenomics, and monitoring clinical trials are used for prognostic (predictive) purposes to thereby treat an individual prophylactically. Accordingly, one aspect of the invention relates to diagnostic assays for determining NOVX protein and/or nucleic acid expression as well as NOVX activity, in the context of a biological sample (e.g., blood, serum, cells, tissue) to thereby determine whether an individual is afflicted with a disease or disorder, or is at risk of developing a disorder, associated with aberrant NOVX expression or activity. The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers.

The invention also provides for prognostic (or predictive) assays for determining whether an individual is at risk of developing a disorder associated with NOVX protein, nucleic acid expression or activity. For example, mutations in an NOVX gene can be assayed in a biological sample. Such assays can be used for prognostic or predictive purpose to thereby prophylactically treat an individual prior to the onset of a disorder characterized by or associated with NOVX protein, nucleic acid expression, or biological activity.

Another aspect of the invention provides methods for determining NOVX protein, nucleic acid expression or activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.)

Yet another aspect of the invention pertains to monitoring the influence of agents (e.g., drugs, compounds) on the expression or activity of NOVX in clinical trials.

These and other agents are described in further detail in the following sections.

Diagnostic Assays

An exemplary method for detecting the presence or absence of NOVX in a biological sample involves obtaining a biological sample from a test subject and contacting the biological sample with a compound or an agent capable of detecting NOVX protein or nucleic acid (e.g., mRNA, genomic DNA) that encodes NOVX protein such that the presence of NOVX is detected in the biological sample. An agent for detecting NOVX mRNA or genomic DNA is a labeled nucleic acid probe capable of hybridizing to NOVX mRNA or genomic DNA. The nucleic acid probe can be, for example, a full-length NOVX nucleic acid, such as the nucleic acid of SEQ ID NOS: 1, 3, 5, 7, 9, 11, 13, 15, 17, 19, 21, 23, 25, 27, 29, 31, 33, 35, 37, 39, 41, 43, 45, 47, 49, and 51, or a portion thereof, such as an oligonucleotide of at least 15, 30, 50, 100, 250 or 500 nucleotides in length and sufficient to specifically hybridize under stringent conditions to NOVX mRNA or genomic DNA. Other suitable probes for use in the diagnostic assays of the invention are described herein.

An agent for detecting NOVX protein is an antibody capable of binding to NOVX protein, preferably an antibody with a detectable label. Antibodies can be polyclonal, or more preferably, monoclonal. An intact antibody, or a fragment thereof (e.g., Fab or $F(ab')_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently-labeled secondary antibody and end-labeling of a DNA probe with biotin such that it can be detected with fluorescently-labeled streptavidin. The term "biological sample" is intended to include tissues, cells and biological fluids isolated from a subject, as well as tissues, cells and fluids present within a subject. That is, the detection method of the invention can be used to detect NOVX mRNA, protein, or genomic DNA in a biological sample in vitro as well as in vivo. For example, in vitro techniques for detection of NOVX mRNA include Northern hybridizations and in situ hybridizations. In vitro techniques for detection of NOVX protein include enzyme linked immunosorbent assays (ELISAs), Western blots, immunoprecipitations, and immunofluorescence. In vitro techniques for detection of NOVX genomic DNA include Southern hybridizations. Furthermore, in vivo techniques for detection of NOVX protein include introducing into a subject a labeled anti-NOVX antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting NOVX protein, mRNA, or genomic DNA, such that the presence of NOVX protein, mRNA or genomic DNA is detected in the biological sample, and comparing the presence of NOVX protein, mRNA or genomic DNA in the control sample with the presence of NOVX protein, mRNA or genomic DNA in the test sample.

The invention also encompasses kits for detecting the presence of NOVX in a biological sample. For example, the kit can comprise: a labeled compound or agent capable of detecting NOVX protein or mRNA in a biological sample; means for determining the amount of NOVX in the sample; and means for comparing the amount of NOVX in the sample with a standard. The compound or agent can be packaged in a suitable container. The kit can further comprise instructions for using the kit to detect NOVX protein or nucleic acid.

Prognostic Assays

The diagnostic methods described herein can furthermore be utilized to identify subjects having or at risk of developing a disease or disorder associated with aberrant NOVX expression or activity. For example, the assays described herein, such as the preceding diagnostic assays or the following assays, can be utilized to identify a subject having or at risk of developing a disorder associated with NOVX protein, nucleic acid expression or activity. Alternatively, the prognostic assays can be utilized to identify a subject having or at risk for developing a disease or disorder. Thus, the invention provides a method for identifying a disease or disorder associated with aberrant NOVX expression or activity in which a test sample is obtained from a subject and NOVX protein or nucleic acid (e.g., mRNA, genomic DNA) is detected, wherein the presence of NOVX protein or nucleic acid is diagnostic for a subject having or at risk of developing a disease or disorder associated with aberrant NOVX expression or activity. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant NOVX expression or activity. For example, such methods can be used to determine whether a subject can be effectively treated with an agent for a disorder. Thus, the invention provides methods for determining whether a subject can be effectively treated with an agent for a disorder associated with aberrant NOVX expression or activity in which a test sample is obtained and NOVX protein or nucleic acid is detected (e.g., wherein the presence of NOVX protein or nucleic acid is diagnostic for a subject that can be administered the agent to treat a disorder associated with aberrant NOVX expression or activity).

The methods of the invention can also be used to detect genetic lesions in an NOVX gene, thereby determining if a subject with the lesioned gene is at risk for a disorder characterized by aberrant cell proliferation and/or differentiation. In various embodiments, the methods include detecting, in a sample of cells from the subject, the presence or absence of a genetic lesion characterized by at least one of an alteration affecting the integrity of a gene encoding an NOVX-protein, or the misexpression of the NOVX gene. For example, such genetic lesions can be detected by ascertaining the existence of at least one of: (i) a deletion of one or more nucleotides from an NOVX gene; (ii) an addition of one or more nucleotides to an NOVX gene; (iii) a substitution of one or more nucleotides of an NOVX gene, (iv) a chromosomal rearrangement of an NOVX gene; (v) an alteration in the level of a messenger RNA transcript of an NOVX gene, (vi) aberrant modification of an NOVX gene, such as of the methylation pattern of the genomic DNA, (vii) the presence of a non-wild-type splicing pattern of a messenger RNA transcript of an NOVX gene, (viii) a non-wild-type level of an NOVX protein, (ix) allelic loss of an NOVX gene, and (x) inappropriate post-translational modification of an NOVX protein. As described herein, there are a large number of assay techniques known in the art which can be used for detecting lesions in an NOVX gene. A preferred biological sample is a peripheral blood leukocyte sample isolated by conventional means from a subject. However, any biological sample containing nucleated cells may be used, including, for example, buccal mucosal cells.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran, et al., 1988. *Science* 241: 1077–1080; and Nakazawa, et al., 1994. *Proc. Natl. Acad. Sci. USA* 91: 360–364), the latter of which can be particularly useful for detecting point mutations in the NOVX-gene (see, Abravaya, et al., 1995. *Nucl. Acids Res.* 23: 675–682). This method can include the steps of collecting a sample of cells from a patient, isolating nucleic acid (e.g., genomic, mRNA or both) from the cells of the sample, contacting the nucleic acid sample with one or more primers that specifically hybridize to an NOVX gene under conditions such that hybridization and amplification of the NOVX gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (see, Guatelli, et al., 1990. *Proc. Natl. Acad. Sci. USA* 87: 1874–1878), transcriptional amplification system (see, Kwoh, et al., 1989. *Proc. Natl. Acad. Sci. USA* 86: 1173–1177); Qβ Replicase (see, Lizardi, et al, 1988. *BioTechnology* 6: 1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in an NOVX gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,493,531) can be used to score for the presence of specific mutations by development or loss of a ribozyme cleavage site.

In other embodiments, genetic mutations in NOVX can be identified by hybridizing a sample and control nucleic acids, e.g., DNA or RNA, to high-density arrays containing hundreds or thousands of oligonucleotides probes. See, e.g., Cronin, et al., 1996. *Human Mutation* 7: 244–255; Kozal, et al., 1996. *Nat. Med.* 2: 753–759. For example, genetic mutations in NOVX can be identified in two dimensional arrays containing light-generated DNA probes as described in Cronin, et al., supra. Briefly, a first hybridization array of probes can be used to scan through long stretches of DNA in a sample and control to identify base changes between the sequences by making linear arrays of sequential overlapping probes. This step allows the identification of point mutations. This is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the NOVX gene and detect mutations by comparing the sequence of the sample NOVX with the corresponding wild-type (control) sequence. Examples of sequencing reactions include those based on techniques developed by Maxim and Gilbert, 1977. *Proc. Natl. Acad. Sci. USA* 74: 560 or Sanger, 1977. *Proc. Natl. Acad. Sci. USA* 74: 5463. It is also contemplated that any of a variety of automated sequencing procedures can be utilized when performing the diagnostic assays (see, e.g., Naeve, et al., 1995. *Biotechniques* 19: 448), including sequencing by mass spectrometry (see, e.g., PCT International Publication No. WO 94/16101; Cohen, et al., 1996. *Adv. Chromatography* 36: 127–162; and Griffin, et al., 1993. *Appl. Biochem. Biotechnol.* 38: 147–159).

Other methods for detecting mutations in the NOVX gene include methods in which protection from cleavage agents is used to detect mismatched bases in RNA/RNA or RNA/DNA heteroduplexes. See, e.g., Myers, et al., 1985. *Science* 230: 1242. In general, the art technique of "mismatch cleavage" starts by providing heteroduplexes of formed by hybridizing (labeled) RNA or DNA containing the wild-type NOVX sequence with potentially mutant RNA or DNA obtained from a tissue sample. The double-stranded duplexes are treated with an agent that cleaves single-stranded regions of the duplex such as which will exist due to basepair mismatches between the control and sample strands. For instance, RNA/DNA duplexes can be treated with RNase and DNA/DNA hybrids treated with $S_1$ nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton, et al, 1988. *Proc. Natl. Acad. Sci. USA* 85: 4397; Saleeba, et al., 1992. *Methods Enzymol.* 217: 286–295. In an embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in NOVX cDNAs obtained from samples of cells. For example, the mutY enzyme of *E. coli* cleaves A at G/A mismatches and the thymidine DNA glycosylase from HeLa cells cleaves T at G/T mismatches. See, e.g., Hsu, et al., 1994. *Carcinogenesis* 15: 1657–1662. According to an exemplary embodiment, a probe based on an NOVX sequence, e.g., a wild-type NOVX sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in NOVX genes. For example, single strand conformation polymorphism (SSCP) may be used to detect differences in electrophoretic mobility between mutant and wild type nucleic acids. See, e.g., Orita, et al., 1989. *Proc. Natl. Acad. Sci. USA:* 86: 2766;

Cotton, 1993. *Mutat. Res.* 285: 125–144; Hayashi, 1992. *Genet. Anal. Tech. Appl.* 9: 73–79. Single-stranded DNA fragments of sample and control NOVX nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In one embodiment, the subject method utilizes heteroduplex analysis to separate double stranded heteroduplex molecules on the basis of changes in electrophoretic mobility. See, e.g., Keen, et al., 1991. *Trends Genet.* 7:5.

In yet another embodiment, the movement of mutant or wild-type fragments in polyacrylamide gels containing a gradient of denaturant is assayed using denaturing gradient gel electrophoresis (DGGE). See, e.g., Myers, et al., 1985. *Nature* 313: 495. When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA. See, e.g., Rosenbaum and Reissner, 1987. *Biophys. Chem.* 265: 12753.

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions that permit hybridization only if a perfect match is found. See, e.g., Saiki, et al., 1986. *Nature* 324: 163; Saiki, et al., 1989. *Proc. Natl. Acad. Sci. USA* 86: 6230. Such allele specific oligonucleotides are hybridized to PCR amplified target DNA or a number of different mutations when the oligonucleotides are attached to the hybridizing membrane and hybridized with labeled target DNA.

Alternatively, allele specific amplification technology that depends on selective PCR amplification may be used in conjunction with the instant invention. Oligonucleotides used as primers for specific amplification may carry the mutation of interest in the center of the molecule (so that amplification depends on differential hybridization; see, e.g., Gibbs, et al., 1989. *Nucl. Acids Res.* 17: 2437–2448) or at the extreme 3'-terminus of one primer where, under appropriate conditions, mismatch can prevent, or reduce polymerase extension (see, e.g., Prossner, 1993. *Tibtech.* 11: 238). In addition it may be desirable to introduce a novel restriction site in the region of the mutation to create cleavage-based detection. See, e.g., Gasparini, et al., 1992. *Mol. Cell Probes* 6: 1. It is anticipated that in certain embodiments amplification may also be performed using Taq ligase for amplification. See, e.g., Barany, 1991. *Proc. Natl. Acad. Sci. USA* 88: 189. In such cases, ligation will occur only if there is a perfect match at the 3'-terminus of the 5' sequence, making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving an NOVX gene.

Furthermore, any cell type or tissue, preferably peripheral blood leukocytes, in which NOVX is expressed may be utilized in the prognostic assays described herein. However, any biological sample containing nucleated cells may be used, including, for example, buccal mucosal cells.

Pharmacogenomics

Agents, or modulators that have a stimulatory or inhibitory effect on NOVX activity (e.g., NOVX gene expression), as identified by a screening assay described herein can be administered to individuals to treat (prophylactically or therapeutically) disorders (The disorders include metabolic disorders, diabetes, obesity, infectious disease, anorexia, cancer-associated cachexia, cancer, neurodegenerative disorders, Alzheimer's Disease, Parkinson's Disorder, immune disorders, and hematopoietic disorders, and the various dyslipidemias, metabolic disturbances associated with obesity, the metabolic syndrome X and wasting disorders associated with chronic diseases and various cancers.) In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of NOVX protein, expression of NOVX nucleic acid, or mutation content of NOVX genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See e.g., Eichelbaum, 1996. *Clin. Exp. Pharmacol. Physiol.*, 23: 983–985; Linder, 1997. *Clin. Chem.*, 43: 254–266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C 19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. At the other extreme are the so called ultra-rapid metabolizers who do not respond to standard doses. Recently, the molecular basis of ultra-rapid metabolism has been identified to be due to CYP2D6 gene amplification.

Thus, the activity of NOVX protein, expression of NOVX nucleic acid, or mutation content of NOVX genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with an NOVX modulator, such as a modulator identified by one of the exemplary screening assays described herein.

Monitoring of Effects during Clinical Trials

Monitoring the influence of agents (e.g., drugs, compounds) on the expression or activity of NOVX (e.g., the ability to modulate aberrant cell proliferation and/or differentiation) can be applied not only in basic drug screening, but also in clinical trials. For example, the effectiveness of an agent determined by a screening assay as described herein to increase NOVX gene expression, protein levels, or upregulate NOVX activity, can be monitored in clinical trails of subjects exhibiting decreased NOVX gene expression, protein levels, or downregulated NOVX activity. Alternatively, the effectiveness of an agent determined by a screening assay to decrease NOVX gene expression, protein levels, or downregulate NOVX activity, can be monitored in clinical trails of subjects exhibiting increased NOVX gene expression, protein levels, or upregulated NOVX activity. In such clinical trials, the expression or activity of NOVX and, preferably, other genes that have been implicated in, for example, a cellular proliferation or immune disorder can be used as a "read out" or markers of the immune responsiveness of a particular cell.

By way of example, and not of limitation, genes, including NOVX, that are modulated in cells by treatment with an agent (e.g., compound, drug or small molecule) that modulates NOVX activity (e.g., identified in a screening assay as described herein) can be identified. Thus, to study the effect of agents on cellular proliferation disorders, for example, in a clinical trial, cells can be isolated and RNA prepared and analyzed for the levels of expression of NOVX and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of NOVX or other genes. In this manner, the gene expression pattern can serve as a marker, indicative of the physiological response of the cells to the agent. Accordingly, this response state may be determined before, and at various points during, treatment of the individual with the agent.

In one embodiment, the invention provides a method for monitoring the effectiveness of treatment of a subject with an agent (e.g., an agonist, antagonist, protein, peptide, peptidomimetic, nucleic acid, small molecule, or other drug candidate identified by the screening assays described herein) comprising the steps of (i) obtaining a pre-administration sample from a subject prior to administration of the agent; (ii) detecting the level of expression of an NOVX protein, mRNA, or genomic DNA in the preadministration sample; (iii) obtaining one or more post-administration samples from the subject; (iv) detecting the level of expression or activity of the NOVX protein, mRNA, or genomic DNA in the post-administration samples; (v) comparing the level of expression or activity of the NOVX protein, mRNA, or genomic DNA in the pre-administration sample with the NOVX protein, mRNA, or genomic DNA in the post administration sample or samples; and (vi) altering the administration of the agent to the subject accordingly. For example, increased administration of the agent may be desirable to increase the expression or activity of NOVX to higher levels than detected, i.e., to increase the effectiveness of the agent. Alternatively, decreased administration of the agent may be desirable to decrease expression or activity of NOVX to lower levels than detected, i.e., to decrease the effectiveness of the agent.

Methods of Treatment

The invention provides for both prophylactic and therapeutic methods of treating a subject at risk of (or susceptible to) a disorder or having a disorder associated with aberrant NOVX expression or activity. The disorders include cardiomyopathy, atherosclerosis, hypertension, congenital heart defects, aortic stenosis, atrial septal defect (ASD), atrioventricular (A-V) canal defect, ductus arteriosus, pulmonary stenosis, subaortic stenosis, ventricular septal defect (VSD), valve diseases, tuberous sclerosis, scleroderma, obesity, transplantation, adrenoleukodystrophy, congenital adrenal hyperplasia, prostate cancer, neoplasm; adenocarcinoma, lymphoma, uterus cancer, fertility, hemophilia, hypercoagulation, idiopathic thrombocytopenic purpura, immunodeficiencies, graft versus host disease, AIDS, bronchial asthma, Crohn's disease; multiple sclerosis, treatment of Albright Hereditary Ostoeodystrophy, and other diseases, disorders and conditions of the like.

These methods of treatment will be discussed more fully, below.

Disease and Disorders

Diseases and disorders that are characterized by increased (relative to a subject not suffering from the disease or disorder) levels or biological activity may be treated with Therapeutics that antagonize (i.e., reduce or inhibit) activity. Therapeutics that antagonize activity may be administered in a therapeutic or prophylactic manner. Therapeutics that may be utilized include, but are not limited to: (i) an aforementioned peptide, or analogs, derivatives, fragments or homologs thereof, (ii) antibodies to an aforementioned peptide; (iii) nucleic acids encoding an aforementioned peptide; (iv) administration of antisense nucleic acid and nucleic acids that are "dysfunctional" (i.e., due to a heterologous insertion within the coding sequences of coding sequences to an aforementioned peptide) that are utilized to "knockout" endogenous function of an aforementioned peptide by homologous recombination (see, e.g., Capecchi, 1989. *Science* 244: 1288–1292); or (v) modulators (i.e., inhibitors, agonists and antagonists, including additional peptide mimetic of the invention or antibodies specific to a peptide of the invention) that alter the interaction between an aforementioned peptide and its binding partner.

Diseases and disorders that are characterized by decreased (relative to a subject not suffering from the disease or disorder) levels or biological activity may be treated with Therapeutics that increase (i.e., are agonists to) activity.

Therapeutics that upregulate activity may be administered in a therapeutic or prophylactic manner. Therapeutics that may be utilized include, but are not limited to, an aforementioned peptide, or analogs, derivatives, fragments or homologs thereof; or an agonist that increases bioavailability.

Increased or decreased levels can be readily detected by quantifying peptide and/or RNA, by obtaining a patient tissue sample (e.g., from biopsy tissue) and assaying it in vitro for RNA or peptide levels, structure and/or activity of the expressed peptides (or mRNAs of an aforementioned peptide). Methods that are well-known within the art include, but are not limited to, immunoassays (e.g., by Western blot analysis, immunoprecipitation followed by sodium dodecyl sulfate (SDS) polyacrylamide gel electrophoresis, immunocytochemistry, etc.) and/or hybridization assays to detect expression of mRNAs (e.g., Northern assays, dot blots, in situ hybridization, and the like).

Prophylactic Methods

In one aspect, the invention provides a method for preventing, in a subject, a disease or condition associated with an aberrant NOVX expression or activity, by administering to the subject an agent that modulates NOVX expression or at least one NOVX activity. Subjects at risk for a disease that is caused or contributed to by aberrant NOVX expression or activity can be identified by, for example, any or a combination of diagnostic or prognostic assays as described herein. Administration of a prophylactic agent can occur prior to the manifestation of symptoms characteristic of the NOVX aberrancy, such that a disease or disorder is prevented or, alternatively, delayed in its progression. Depending upon the type of NOVX aberrancy, for example, an NOVX agonist or NOVX antagonist agent can be used for treating the subject. The appropriate agent can be determined based on screening assays described herein. The prophylactic methods of the invention are further discussed in the following subsections.

Therapeutic Methods

Another aspect of the invention pertains to methods of modulating NOVX expression or activity for therapeutic purposes. The modulatory method of the invention involves contacting a cell with an agent that modulates one or more of the activities of NOVX protein activity associated with the cell. An agent that modulates NOVX protein activity can be an agent as described herein, such as a nucleic acid or a protein, a naturally-occurring cognate ligand of an NOVX protein, a peptide, an NOVX peptidomimetic, or other small molecule. In one embodiment, the agent stimulates one or more NOVX protein activity. Examples of such stimulatory agents include active NOVX protein and a nucleic acid molecule encoding NOVX that has been introduced into the cell. In another embodiment, the agent inhibits one or more NOVX protein activity. Examples of such inhibitory agents include antisense NOVX nucleic acid molecules and anti-NOVX antibodies. These modulatory methods can be performed in vitro (e.g., by culturing the cell with the agent) or, alternatively, in vivo (e.g., by administering the agent to a subject). As such, the invention provides methods of treating an individual afflicted with a disease or disorder characterized by aberrant expression or activity of an NOVX protein or nucleic acid molecule. In one embodiment, the method involves administering an agent (e.g., an agent identified by a screening assay described herein), or combination of agents that modulates (e.g., up-regulates or down-regulates) NOVX expression or activity. In another embodiment, the method involves administering an NOVX protein or nucleic acid molecule as therapy to compensate for reduced or aberrant NOVX expression or activity.

Stimulation of NOVX activity is desirable in situations in which NOVX is abnormally downregulated and/or in which increased NOVX activity is likely to have a beneficial effect. One example of such a situation is where a subject has a disorder characterized by aberrant cell proliferation and/or differentiation (e.g., cancer or immune associated disorders). Another example of such a situation is where the subject has a gestational disease (e.g., preclampsia).

Determination of the Biological Effect of the Therapeutic

In various embodiments of the invention, suitable in vitro or in vivo assays are performed to determine the effect of a specific Therapeutic and whether its administration is indicated for treatment of the affected tissue.

In various specific embodiments, in vitro assays may be performed with representative cells of the type(s) involved in the patient's disorder, to determine if a given Therapeutic exerts the desired effect upon the cell type(s). Compounds for use in therapy may be tested in suitable animal model systems including, but not limited to rats, mice, chicken, cows, monkeys, rabbits, and the like, prior to testing in human subjects. Similarly, for in vivo testing, any of the animal model system known in the art may be used prior to administration to human subjects.

Prophylactic and Therapeutic Uses of the Compositions of the Invention

The NOVX nucleic acids and proteins of the invention are useful in potential prophylactic and therapeutic applications implicated in a variety of disorders including, but not limited to: metabolic disorders, diabetes, obesity, infectious disease, anorexia, cancer-associated cancer, neurodegenerative disorders, Alzheimer's Disease, Parkinson's Disorder, immune disorders, hematopoietic disorders, and the various dyslipidemias, metabolic disturbances associated with obesity, the metabolic syndrome X and wasting disorders associated with chronic diseases and various cancers.

As an example, a cDNA encoding the NOVX protein of the invention may be useful in gene therapy, and the protein may be useful when administered to a subject in need thereof. By way of non-limiting example, the compositions of the invention will have efficacy for treatment of patients suffering from: metabolic disorders, diabetes, obesity, infectious disease, anorexia, cancer-associated cachexia, cancer, neurodegenerative disorders, Alzheimer's Disease, Parkinson's Disorder, immune disorders, hematopoietic disorders, and the various dyslipidemias.

Both the novel nucleic acid encoding the NOVX protein, and the NOVX protein of the invention, or fragments thereof, may also be useful in diagnostic applications, wherein the presence or amount of the nucleic acid or the protein are to be assessed. A further use could be as an anti-bacterial molecule (i.e., some peptides have been found to possess anti-bacterial properties). These materials are further useful in the generation of antibodies, which immunospecifically-bind to the novel substances of the invention for use in therapeutic or diagnostic methods.

The invention will be further described in the following examples, which do not limit the scope of the invention described in the claims.

EXAMPLES

Example 1

Identification of NOVX Clones

The novel NOVX target sequences identified in the present invention were subjected to the exon linking process to confirm the sequence. PCR primers were designed by starting at the most upstream sequence available, for the forward primer, and at the most downstream sequence available for the reverse primer. Table 21A shows the sequences of the PCR primers used for obtaining different clones. In each case, the sequence was examined, walking inward from the respective termini toward the coding sequence, until a suitable sequence that is either unique or highly selective was encountered, or, in the case of the reverse primer, until the stop codon was reached. Such primers were designed based on in silico predictions for the full length cDNA, part (one or more exons) of the DNA or protein sequence of the target sequence, or by translated homology of the predicted exons to closely related human sequences from other species. These primers were then employed in PCR amplification based on the following pool of human cDNAs: adrenal gland, bone marrow, brain—amygdala, brain—cerebellum, brain—hippocampus, brain—substantia nigra, brain—thalamus, brain—whole, fetal brain, fetal kidney, fetal liver, fetal lung, heart, kidney, lymphoma—Raji, mammary gland, pancreas, pituitary gland, placenta, prostate, salivary gland, skeletal muscle, small intestine, spinal cord, spleen, stomach, testis, thyroid, trachea, uterus. Usually the resulting amplicons were gel purified, cloned and sequenced to high redundancy. The PCR product derived from exon linking was cloned into the pCR2.1 vector from Invitrogen. The resulting bacterial clone has an insert covering the entire open reading frame cloned into the pCR2.1 vector. The resulting sequences from all clones were assembled with themselves, with other fragments in CuraGen Corporation's database and with public ESTs. Fragments and ESTs were included as components for an assembly when the extent of their identity with another component of the assembly was at least 95% over 50 bp. In addition, sequence traces were evaluated manually and edited for corrections if appropriate. These procedures provide the sequence reported herein.

for apparent inconsistencies thereby obtaining the sequences encoding the full-length protein.

TABLE 21B

Physical Clones for PCR products

| NOVX Clone | Bacterial Clone |
|---|---|
| 8b | 115399::10108437.698322.A12 |
| 9b | GSAC046130_A.698352.H12 |
| 19b | MBNM_004056.698344.F5 |

Example 2

Quantitative Expression Analysis of Clones in Various Cells and Tissues

The quantitative expression of various clones was assessed using microtiter plates containing RNA samples from a variety of normal and pathology-derived cells, cell lines and tissues using real time quantitative PCR (RTQ PCR). RTQ PCR was performed on an Applied Biosystems ABI PRISM® 7700 or an ABI PRISM® 7900 HT Sequence Detection System. Various collections of samples are assembled on the plates, and referred to as Panel 1 (containing normal tissues and cancer cell lines), Panel 2 (containing samples derived from tissues from normal and cancer sources), Panel 3 (containing cancer cell lines), Panel 4 (containing cells and cell lines from normal tissues and cells related to inflammatory conditions), Panel 5D/5I (containing human tissues and cell lines with an emphasis on metabolic diseases), AI_comprehensive_panel (containing normal tissue and samples from autoinflammatory diseases), Panel CNSD.01 (containing samples from normal and diseased brains) and CNS_neurodegeneration_panel (containing samples from normal and Alzheimer's diseased brains).

TABLE 21A

PCR Primers for Exon Linking

| NOVX Clone | Primer 1 (5'-3') | SEQ ID NO | Primer 2 (5'-3') | SEQ ID NO |
|---|---|---|---|---|
| 8b | CAGCGGGGCCCGCATTGAG | 153 | CCCGGTTATTTGTAGGGCCG | 154 |
| 9b | AGAATTTTCCAGGAGTAGGTTCTTGG | 155 | ACCTTTGAATGTCCTGACTATTTGGC | 156 |
| 12 | GCGTAGCCGTAGAGGTGCACAGAGA | 157 | CAACACACGCGCCAGGTTAGCTTTAC | 158 |
| 13 | ATGAGCCGCCAATTCACCTA | 159 | ACCTGCTGGCCTCCAATTACT | 160 |
| 15a | TAGCTAACAAGTACTATGGGAGCCCAA | 161 | TGTAGTTTCATGTTCTTGTCACCAACC | 162 |
| 15b | TCGTCTCCGTGGGTGTGGC | 163 | CCAGGACAGGAGGGTTTATGCAGA | 164 |
| 19a | ATGGCGGACCTGAGCTTC | 165 | CTTATCCAAGGGCATTATAGACCA | 166 |
| 19b | ATGGCGGACCTGACCTTC | 167 | CTTATCCAAGGGCATTATAGACCA | 168 |

Physical clone: Exons were predicted by homology and the intron/exon boundaries were determined using standard genetic rules. Exons were further selected and refined by means of similarity determination using multiple BLAST (for example, tBlastN, BlastX, and BlastN) searches, and, in some instances, GeneScan and Grail. Expressed sequences from both public and proprietary databases were also added when available to further define and complete the gene sequence. The DNA sequence was then manually corrected RNA integrity from all samples is controlled for quality by visual assessment of agarose gel electropherograms using 28S and 18S ribosomal RNA staining intensity ratio as a guide (2:1 to 2.5:1 28s:18s) and the absence of low molecular weight RNAs that would be indicative of degradation products. Samples are controlled against genomic DNA contamination by RTQ PCR reactions run in the absence of reverse transcriptase using probe and primer sets designed to amplify across the span of a single exon.

First, the RNA samples were normalized to reference nucleic acids such as constitutively expressed genes (for example, β-actin and GAPDH). Normalized RNA (5 ul) was converted to cDNA and analyzed by RTQ-PCR using One Step RT-PCR Master Mix Reagents (Applied Biosystems; Catalog No. 4309169) and gene-specific primers according to the manufacturer's instructions.

In other cases, non-normalized RNA samples were converted to single strand cDNA (sscDNA) using Superscript II (Invitrogen Corporation; Catalog No. 18064-147) and random hexamers according to the manufacturer's instructions. Reactions containing up to 10 µg of total RNA were performed in a volume of 20 µl and incubated for 60 minutes at 42° C. This reaction can be scaled up to 50 µg of total RNA in a final volume of 100 µl. sscDNA samples are then normalized to reference nucleic acids as described previously, using 1× TaqMang® Universal Master mix (Applied Biosystems; catalog No. 4324020), following the manufacturer's instructions.

Probes and primers were designed for each assay according to Applied Biosystems Primer Express Software package (version I for Apple Computer's Macintosh Power PC) or a similar algorithm using the target sequence as input. Default settings were used for reaction conditions and the following parameters were set before selecting primers: primer concentration=250 nM, primer melting temperature (Tm) range=58°–60° C., primer optimal Tm=59° C., maximum primer difference=2° C., probe does not have 5'G, probe Tm must be 10° C. greater than primer Tm, amplicon size 75 bp to 100 bp. The probes and primers selected (see below) were synthesized by Synthegen (Houston, Tex., USA). Probes were double purified by HPLC to remove uncoupled dye and evaluated by mass spectroscopy to verify coupling of reporter and quencher dyes to the 5' and 3' ends of the probe, respectively. Their final concentrations were: forward and reverse primers, 900 nM each, and probe, 200 nM.

PCR conditions: When working with RNA samples, normalized RNA from each tissue and each cell line was spotted in each well of either a 96 well or a 384-well PCR plate (Applied Biosystems). PCR cocktails included either a single gene specific probe and primers set, or two multiplexed probe and primers sets (a set specific for the target clone and another gene-specific set multiplexed with the target probe). PCR reactions were set up using TaqMan® One-Step RT-PCR Master Mix (Applied Biosystems, Catalog No. 4313803) following manufacturer's instructions. Reverse transcription was performed at 48° C. for 30 minutes followed by amplification/PCR cycles as follows: 95° C. 10 min, then 40 cycles of 95° C. for 15 seconds, 60° C. for 1 minute. Results were recorded as CT values (cycle at which a given sample crosses a threshold level of fluorescence) using a log scale, with the difference in RNA concentration between a given sample and the sample with the lowest CT value being represented as 2 to the power of delta CT. The percent relative expression is then obtained by taking the reciprocal of this RNA difference and multiplying by 100.

When working with sscDNA samples, normalized sscDNA was used as described previously for RNA samples. PCR reactions containing one or two sets of probe and primers were set up as described previously, using 1×TaqMan® Universal Master mix (Applied Biosystems; catalog No. 4324020), following the manufacturer's instructions. PCR amplification was performed as follows: 95° C. 10 min, then 40 cycles of 95° C. for 15 seconds, 60° C. for 1 minute. Results were analyzed and processed as described previously.

Panels 1, 1.1, 1.2, and 1.3D

The plates for Panels 1, 1.1, 1.2 and 1.3D include 2 control wells (genomic DNA control and chemistry control) and 94 wells containing cDNA from various samples. The samples in these panels are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in these panels are widely available through the American Type Culture Collection (ATCC), a repository for cultured cell lines, and were cultured using the conditions recommended by the ATCC. The normal tissues found on these panels are comprised of samples derived from all major organ systems from single adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose.

In the results for Panels 1, 1.1, 1.2 and 1.3D, the following abbreviations are used:

ca.=carcinoma,
*=established from metastasis,
met=metastasis,
s cell var=small cell variant,
non-s=non-sm=non-small,
squam=squamous,
pl. eff=pl effusion=pleural effusion,
glio=glioma,
astro=astrocytoma, and
neuro=neuroblastoma.

General_Screening_Panel_v1.4

The plates for Panel 1.4 include 2 control wells (genomic DNA control and chemistry control) and 94 wells containing cDNA from various samples. The samples in Panel 1.4 are broken into 2 classes: samples derived from cultured cell lines and samples derived from primary normal tissues. The cell lines are derived from cancers of the following types: lung cancer, breast cancer, melanoma, colon cancer, prostate cancer, CNS cancer, squamous cell carcinoma, ovarian cancer, liver cancer, renal cancer, gastric cancer and pancreatic cancer. Cell lines used in Panel 1.4 are widely available through the American Type Culture Collection (ATCC), a repository for cultured cell lines, and were cultured using the conditions recommended by the ATCC. The normal tissues found on Panel 1.4 are comprised of pools of samples derived from all major organ systems from 2 to 5 different adult individuals or fetuses. These samples are derived from the following organs: adult skeletal muscle, fetal skeletal muscle, adult heart, fetal heart, adult kidney, fetal kidney, adult liver, fetal liver, adult lung, fetal lung, various regions of the brain, the spleen, bone marrow, lymph node, pancreas, salivary gland, pituitary gland, adrenal gland, spinal cord, thymus, stomach, small intestine, colon, bladder, trachea, breast, ovary, uterus, placenta, prostate, testis and adipose. Abbreviations are as described for Panels 1, 1.1, 1.2, and 1.3D.

Panels 2D and 2.2

The plates for Panels 2D and 2.2 generally include 2 control wells and 94 test samples composed of RNA or cDNA isolated from human tissue procured by surgeons working in close cooperation with the National Cancer Institute's Cooperative Human Tissue Network (CHTN) or the National Disease Research Initiative (NDRI). The tissues are derived from human malignancies and in cases where indicated many malignant tissues have "matched margins" obtained from noncancerous tissue just adjacent to the tumor. These are termed normal adjacent tissues and are denoted "NAT" in the results below. The tumor tissue and the "matched margins" are evaluated by two independent pathologists (the surgical pathologists and again by a pathologist at NDRI or CHTN). This analysis provides a gross histopathological assessment of tumor differentiation grade. Moreover, most samples include the original surgical pathology report that provides information regarding the clinical stage of the patient. These matched margins are taken from the tissue surrounding (i.e. immediately proximal) to the zone of surgery (designated "NAT", for normal adjacent tissue, in Table RR). In addition, RNA and cDNA samples were obtained from various human tissues derived from autopsies performed on elderly people or sudden death victims (accidents, etc.). These tissues were ascertained to be free of disease and were purchased from various commercial sources such as Clontech (Palo Alto, Calif.), Research Genetics, and Invitrogen.

Panel 3D

The plates of Panel 3D are comprised of 94 cDNA samples and two control samples. Specifically, 92 of these samples are derived from cultured human cancer cell lines, 2 samples of human primary cerebellar tissue and 2 controls. The human cell lines are generally obtained from ATCC (American Type Culture Collection), NCI or the German tumor cell bank and fall into the following tissue groups: Squamous cell carcinoma of the tongue, breast cancer, prostate cancer, melanoma, epidermoid carcinoma, sarcomas, bladder carcinomas, pancreatic cancers, kidney cancers, leukemias/lymphomas, ovarian/uterine/cervical, gastric, colon, lung and CNS cancer cell lines. In addition, there are two independent samples of cerebellum. These cells are all cultured under standard recommended conditions and RNA extracted using the standard procedures. The cell lines in panel 3D and 1.3D are of the most common cell lines used in the scientific literature.

Panels 4D, 4R, and 4.1D

Panel 4 includes samples on a 96 well plate (2 control wells, 94 test samples) composed of RNA (Panel 4R) or cDNA (Panels 4D/4.1D) isolated from various human cell lines or tissues related to inflammatory conditions. Total RNA from control normal tissues such as colon and lung (Stratagene, La Jolla, Calif.) and thymus and kidney (Clontech) was employed. Total RNA from liver tissue from cirrhosis patients and kidney from lupus patients was obtained from BioChain (Biochain Institute, Inc., Hayward, Calif.). Intestinal tissue for RNA preparation from patients diagnosed as having Crohn's disease and ulcerative colitis was obtained from the National Disease Research Interchange (NDRI) (Philadelphia, Pa.).

Astrocytes, lung fibroblasts, dermal fibroblasts, coronary artery smooth muscle cells, small airway epithelium, bronchial epithelium, microvascular dermal endothelial cells, microvascular lung endothelial cells, human pulmonary aortic endothelial cells, human umbilical vein endothelial cells were all purchased from Clonetics (Walkersville, Md.) and grown in the media supplied for these cell types by Clonetics. These primary cell types were activated with various cytokines or combinations of cytokines for 6 and/or 12–14 hours, as indicated. The following cytokines were used; IL-1 beta at approximately 1–5 ng/ml, TNF alpha at approximately 5–10 ng/ml, IFN gamma at approximately 20–50 ng/ml, IL-4 at approximately 5–10 ng/ml, IL-9 at approximately 5–10 ng/ml, IL-13 at approximately 5–10 ng/ml. Endothelial cells were sometimes starved for various times by culture in the basal media from Clonetics with 0.1% serum.

Mononuclear cells were prepared from blood of employees at CuraGen Corporation, using Ficoll. LAK cells were prepared from these cells by culture in DMEM 5% FCS (Hyclone), 100 µM non essential amino acids (Gibco/Life Technologies, Rockville, Md.), 1 mM sodium pyruvate (Gibco), mercaptoethanol $5.5 \times 10^{-5}$M (Gibco), and 10 mM Hepes (Gibco) and Interleukin 2 for 4–6 days. Cells were then either activated with 10–20 ng/ml PMA and 1–2 µg/ml ionomycin, IL-12 at 5–10 ng/ml, IFN gamma at 20–50 ng/ml and IL-18 at 5–10 ng/ml for 6 hours. In some cases, mononuclear cells were cultured for 4–5 days in DMEM 5% FCS (Hyclone), 100 µM non essential amino acids (Gibco), 1 mM sodium pyruvate (Gibco), mercaptoethanol $5.5 \times 10^{-5}$M (Gibco), and 10 mM Hepes (Gibco) with PHA (phytohemagglutinin) or PWM (pokeweed mitogen) at approximately 5 µg/ml. Samples were taken at 24, 48 and 72 hours for RNA preparation. MLR (mixed lymphocyte reaction) samples were obtained by taking blood from two donors, isolating the mononuclear cells using Ficoll and mixing the isolated mononuclear cells 1:1 at a final concentration of approximately $2 \times 10^6$cells/ml in DMEM 5% FCS (Hyclone), 100 µM non essential amino acids (Gibco), 1 mM sodium pyruvate (Gibco), mercaptoethanol ($5.5 \times 10^{-5}$M) (Gibco), and 10 mM Hepes (Gibco). The MLR was cultured and samples taken at various time points ranging from 1–7 days for RNA preparation.

Monocytes were isolated from mononuclear cells using CD14 Miltenyi Beads, +ve VS selection columns and a Vario Magnet according to the manufacturer's instructions. Monocytes were differentiated into dendritic cells by culture in DMEM 5% fetal calf serum (FCS) (Hyclone, Logan, UT), 100 µM non essential amino acids (Gibco), 1 mM sodium pyruvate (Gibco), mercaptoethanol $5.5 \times 10^{-5}$M (Gibco), and 10 mM Hepes (Gibco), 50 ng/ml GMCSF and 5 ng/ml IL-4 for 5–7 days. Macrophages were prepared by culture of monocytes for 5–7 days in DMEM 5% FCS (Hyclone), 100 µM non essential amino acids (Gibco), 1 mM sodium pyruvate (Gibco), mercaptoethanol $5.5 \times 10^{-5}$M (Gibco), 10 mM Hepes (Gibco) and 10% AB Human Serum or MCSF at approximately 50 ng/ml. Monocytes, macrophages and dendritic cells were stimulated for 6 and 12–14 hours with lipopolysaccharide (LPS) at 100 ng/ml. Dendritic cells were also stimulated with anti-CD40 monoclonal antibody (Pharmingen) at 10 µg/ml for 6 and 12–14 hours.

CD4 lymphocytes, CD8 lymphocytes and NK cells were also isolated from mononuclear cells using CD4, CD8 and CD56 Miltenyi beads, positive VS selection columns and a Vario Magnet according to the manufacturer's instructions. CD45RA and CD45RO CD4 lymphocytes were isolated by depleting mononuclear cells of CD8, CD56, CD14 and CD19 cells using CD8, CD56, CD14 and CD19 Miltenyi beads and positive selection. CD45RO beads were then used to isolate the CD45RO CD4 lymphocytes with the remaining cells being CD45RA CD4 lymphocytes. CD45RA CD4, CD45RO CD4 and CD8 lymphocytes were placed in DMEM 5% FCS (Hyclone), 100 µM non essential amino acids (Gibco), 1 mM sodium pyruvate (Gibco), mercaptoethanol $5.5 \times 10^{-5}$M (Gibco), and 10 mM Hepes (Gibco) and plated at $10^6$ cells/ml onto Falcon 6 well tissue culture plates that had been coated overnight with 0.5 µg/ml anti-CD28 (Pharmingen) and 3 ug/ml anti-CD3 (OKT3, ATCC) in PBS.

After 6 and 24 hours, the cells were harvested for RNA preparation. To prepare chronically activated CD8 lymphocytes, we activated the isolated CD8 lymphocytes for 4 days on anti-CD28 and anti-CD3 coated plates and then harvested the cells and expanded them in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco) and IL-2. The expanded CD8 cells were then activated again with plate bound anti-CD3 and anti-CD28 for 4 days and expanded as before. RNA was isolated 6 and 24 hours after the second activation and after 4 days of the second expansion culture. The isolated NK cells were cultured in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco) and IL-2 for 4–6 days before RNA was prepared.

To obtain B cells, tonsils were procured from NDRI. The tonsil was cut up with sterile dissecting scissors and then passed through a sieve. Tonsil cells were then spun down and resupended at $10^6$ cells/ml in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco). To activate the cells, we used PWM at 5 μg/ml or anti-CD40 (Pharmingen) at approximately 10 μg/ml and IL-4 at 5–10 ng/ml. Cells were harvested for RNA preparation at 24,48 and 72 hours.

To prepare the primary and secondary Th1/Th2 and Tr1 cells, six-well Falcon plates were coated overnight with 10 μg/ml anti-CD28 (Pharmingen) and 2 μg/ml OKT3 (ATCC), and then washed twice with PBS. Umbilical cord blood CD4 lymphocytes (Poietic Systems, German Town, Md.) were cultured at $10^{5-10^6}$ cells/ml in DMEM 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco) and IL-2 (4 ng/ml). IL-12 (5 ng/ml) and anti-IL4 (1 μg/ml) were used to direct to Th1, while IL-4 (5 ng/ml) and anti-IFN gamma (1 μg/ml) were used to direct to Th2 and IL-10 at 5 ng/ml was used to direct to Tr1. After 4–5 days, the activated Th1, Th2 and Tr1 lymphocytes were washed once in DMEM and expanded for 4–7 days in DMEM 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco) and IL-2 (1 ng/ml). Following this, the activated Th1, Th2 and Tr1 lymphocytes were re-stimulated for 5 days with anti-CD28/OKT3 and cytokines as described above, but with the addition of anti-CD95L (1 μg/ml) to prevent apoptosis. After 4–5 days, the Th1, Th2 and Tr1 lymphocytes were washed and then expanded again with IL-2 for 4–7 days. Activated Th1 and Th2 lymphocytes were maintained in this way for a maximum of three cycles. RNA was prepared from primary and secondary Th1, Th2 and Tr1 after 6 and 24 hours following the second and third activations with plate bound anti-CD3 and anti-CD28 mAbs and 4 days into the second and third expansion cultures in Interleukin 2.

The following leukocyte cells lines were obtained from the ATCC: Ramos, EOL-1, KU-812. EOL cells were further differentiated by culture in 0.1 mM dbcAMP at $5 \times 10^5$ cells/ml for 8 days, changing the media every 3 days and adjusting the cell concentration to $5 \times 10^5$ cells/ml. For the culture of these cells, we used DMEM or RPMI (as recommended by the ATCC), with the addition of 5% FCS (Hyclone), 100 μM non essential amino acids (Gibco), 1 mM sodium pyruvate (Gibco), mercaptoethanol $5.5 \times 10^{-5}$M (Gibco), 10 mM Hepes (Gibco). RNA was either prepared from resting cells or cells activated with PMA at 10 ng/ml and ionomycin at 1 μg/ml for 6 and 14 hours. Keratinocyte line CCD106 and an airway epithelial tumor line NCI-H292 were also obtained from the ATCC. Both were cultured in DMEM 5% FCS (Hyclone), 100 μM non essential amino acids (Gibco), 1 mM sodium pyruvate (Gibco), mercaptoethanol $5.5 \times 10^{-5}$M (Gibco), and 10 mM Hepes (Gibco). CCD1106 cells were activated for 6 and 14 hours with approximately 5 ng/ml TNF alpha and 1 ng/ml IL-1 beta, while NCI-H292 cells were activated for 6 and 14 hours with the following cytokines: 5 ng/ml IL-4, 5 ng/ml IL-9, 5 ng/ml IL-13 and 25 ng/ml IFN gamma.

For these cell lines and blood cells, RNA was prepared by lysing approximately $10^7$ cells/ml using Trizol (Gibco BRL). Briefly, 1/10 volume of bromochloropropane (Molecular Research Corporation) was added to the RNA sample, vortexed and after 10 minutes at room temperature, the tubes were spun at 14,000 rpm in a Sorvall SS34 rotor. The aqueous phase was removed and placed in a 15 ml Falcon Tube. An equal volume of isopropanol was added and left at −20° C. overnight. The precipitated RNA was spun down at 9,000 rpm for 15 min in a Sorvall SS34 rotor and washed in 70% ethanol. The pellet was redissolved in 300 μl of RNAse-free water and 35 μl buffer (Promega) 5 μl DTT, 7 μl RNAsin and 8 μl DNAse were added. The tube was incubated at 37° C. for 30 minutes to remove contaminating genomic DNA, extracted once with phenol chloroform and re-precipitated with 1/10 volume of 3M sodium acetate and 2 volumes of 100% ethanol. The RNA was spun down and placed in RNAse free water. RNA was stored at −80° C.

AI_Comprehensive Panel_v1.0

The plates for AI_comprehensive panel_v1.0 include two control wells and 89 tests samples comprised of cDNA isolated from surgical and postmortem human tissues obtained from the Backus Hospital and Clinomics (Frederick, Md.). Total RNA was extracted from tissue samples from the Backus Hospital in the Facility at CuraGen. Total RNA from other tissues was obtained from Clinomics.

Joint tissues including synovial fluid, synovium, bone and cartilage were obtained from patients undergoing total knee or hip replacement surgery at the Backus Hospital. Tissue samples were immediately snap frozen in liquid nitrogen to ensure that isolated RNA was of optimal quality and not degraded. Additional samples of osteoarthritis and rheumatoid arthritis joint tissues were obtained from Clinomics. Normal control tissues were supplied by Clinomics and were obtained during autopsy of trauma victims.

Surgical specimens of psoriatic tissues and adjacent matched tissues were provided as total RNA by Clinomics. Two male and two female patients were selected between the ages of 25 and 47. None of the patients were taking prescription drugs at the time samples were isolated.

Surgical specimens of diseased colon from patients with ulcerative colitis and Crohns disease and adjacent matched tissues were obtained from Clinomics. Bowel tissue from three female and three male Crohn's patients between the ages of 41–69 were used. Two patients were not on prescription medication while the others were taking dexamethasone, phenobarbital, or tylenol. Ulcerative colitis tissue was from three male and four female patients. Four of the patients were taking lebvid and two were on phenobarbital.

Total RNA from post mortem lung tissue from trauma victims with no disease or with emphysema, asthma or COPD was purchased from Clinomics. Emphysema patients ranged in age from 40–70 and all were smokers, this age range was chosen to focus on patients with cigarette-linked emphysema and to avoid those patients with alpha-lantitrypsin deficiencies. Asthma patients ranged in age from 36–75, and excluded smokers to prevent those patients that could also have COPD. COPD patients ranged in age from 35–80 and included both smokers and non-smokers. Most patients were taking corticosteroids, and bronchodilators.

In the labels employed to identify tissues in the AI_comprehensive panel_v1.0 panel, the following abbreviations are used:

AI=Autoimmunity
Syn=Synovial
Normal=No apparent disease
Rep22/Rep20=individual patients
RA=Rheumatoid arthritis
Backus=From Backus Hospital
OA=Osteoarthritis
(SS) (BA) (MF)=Individual patients
Adj=Adjacent tissue
Match control=adjacent tissues
-M=Male
-F=Female
COPD=Chronic obstructive pulmonary disease Panels 5D and 5I The plates for Panel 5D and 5I include two control wells and a variety of cDNAs isolated from human tissues and cell lines with an emphasis on metabolic diseases. Metabolic tissues were obtained from patients enrolled in the Gestational Diabetes study. Cells were obtained during different stages in the differentiation of adipocytes from human mesenchymal stem cells. Human pancreatic islets were also obtained.

In the Gestational Diabetes study subjects are young (18–40 years), otherwise healthy women with and without gestational diabetes undergoing routine (elective) Caesarean section. After delivery of the infant, when the surgical incisions were being repaired/closed, the obstetrician removed a small sample.

Patient 2: Diabetic Hispanic, overweight, not on insulin
Patient 7–9: Nondiabetic Caucasian and obese (BMI>30)
Patient 10: Diabetic Hispanic, overweight, on insulin
Patient 11: Nondiabetic African American and overweight
Patient 12: Diabetic Hispanic on insulin Adipocyte differentiation was induced in donor progenitor cells obtained from Osirus (a division of Clonetics/BioWhittaker) in triplicate, except for Donor 3U which had only two replicates. Scientists at Clonetics isolated, grew and differentiated human mesenchymal stem cells (HuMSCs) for CuraGen based on the published protocol found in Mark F. Pittenger, et al., Multilineage Potential of Adult Human Mesenchymal Stem Cells Science Apr. 2, 1999: 143–147. Clonetics provided Trizol lysates or frozen pellets suitable for mRNA isolation and ds cDNA production. A general description of each donor is as follows:

Donor 2 and 3 U: Mesenchymal Stem cells, Undifferentiated Adipose
Donor 2 and 3 AM: Adipose, AdiposeMidway Differentiated
Donor 2 and 3 AD: Adipose, Adipose Differentiated Human cell lines were generally obtained from ATCC (American Type Culture Collection), NCI or the German tumor cell bank and fall into the following tissue groups: kidney proximal convoluted tubule, uterine smooth muscle cells, small intestine, liver HepG2 cancer cells, heart primary stromal cells, and adrenal cortical adenoma cells. These cells are all cultured under standard recommended conditions and RNA extracted using the standard procedures. All samples were processed at CuraGen to produce single stranded cDNA.

Panel 5I contains all samples previously described with the addition of pancreatic islets from a 58 year old female patient obtained from the Diabetes Research Institute at the University of Miami School of Medicine. Islet tissue was processed to total RNA at an outside source and delivered to CuraGen for addition to panel 5I.

In the labels employed to identify tissues in the 5D and 5I panels, the following abbreviations are used:

GO Adipose=Greater Omentum Adipose
SK=Skeletal Muscle
UT=Uterus
PL=Placenta
AD=Adipose Differentiated
AM=Adipose Midway Differentiated
U=Undifferentiated Stem Cells Panel CNSD.01

The plates for Panel CNSD.01 include two control wells and 94 test samples comprised of cDNA isolated from postmortem human brain tissue obtained from the Harvard Brain Tissue Resource Center. Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains two brains from each of the following diagnoses: Alzheimer's disease, Parkinson's disease, Huntington's disease, Progressive Supernuclear Palsy, Depression, and "Normal controls". Within each of these brains, the following regions are represented: cingulate gyrus, temporal pole, globus palladus, substantia nigra, Brodman Area 4 (primary motor strip), Brodman Area 7 (parietal cortex), Brodman Area 9 (prefrontal cortex), and Brodman area 17 (occipital cortex). Not all brain regions are represented in all cases; e.g., Huntington's disease is characterized in part by neurodegeneration in the globus palladus, thus this region is impossible to obtain from confirmed Huntington's cases. Likewise Parkinson's disease is characterized by degeneration of the substantia nigra making this region more difficult to obtain. Normal control brains were examined for neuropathology and found to be free of any pathology consistent with neurodegeneration.

In the labels employed to identify tissues in the CNS panel, the following abbreviations are used:

PSP=Progressive supranuclear palsy
Sub Nigra=Substantia nigra
Glob Palladus=Globus palladus
Temp Pole=Temporal pole
Cing Gyr=Cingulate gyrus
BA 4=Brodman Area 4

Panel CNS_Neurodegeneration_V1.0

The plates for Panel CNS_Neurodegeneration_V1.0 include two control wells and 47 test samples comprised of cDNA isolated from postmortem human brain tissue obtained from the Harvard Brain Tissue Resource Center (McLean Hospital) and the Human Brain and Spinal Fluid Resource Center (VA Greater Los Angeles Healthcare System). Brains are removed from calvaria of donors between 4 and 24 hours after death, sectioned by neuroanatomists, and frozen at −80° C. in liquid nitrogen vapor. All brains are sectioned and examined by neuropathologists to confirm diagnoses with clear associated neuropathology.

Disease diagnoses are taken from patient records. The panel contains six brains from Alzheimer's disease (AD)

patients, and eight brains from "Normal controls" who showed no evidence of dementia prior to death. The eight normal control brains are divided into two categories: Controls with no dementia and no Alzheimer's like pathology (Controls) and controls with no dementia but evidence of severe Alzheimer's like pathology, (specifically senile plaque load rated as level 3 on a scale of 0–3; 0=no evidence of plaques, 3=severe AD senile plaque load). Within each of these brains, the following regions are represented: hippocampus, temporal cortex (Brodman Area 21), parietal cortex (Brodman area 7), and occipital cortex (Brodman area 17). These regions were chosen to encompass all levels of neurodegeneration in AD. The hippocampus is a region of early and severe neuronal loss in AD; the temporal cortex is known to show neurodegeneration in AD after the hippocampus; the parietal cortex shows moderate neuronal death in the late stages of the disease; the occipital cortex is spared in AD and therefore acts as a "control" region within AD patients. Not all brain regions are represented in all cases.

In the labels employed to identify tissues in the CNS_Neurodegeneration_V1.0 panel, the following abbreviations are used:

AD=Alzheimer's disease brain; patient was demented and showed AD-like pathology upon autopsy Control=Control brains; patient not demented, showing no neuropathology Control (Path)=Control brains; pateint not demented but showing sever AD-like pathology SupTemporal Ctx=Superior Temporal Cortex lnf Temporal Ctx=Inferior Temporal Cortex

A. NOV8

134929133_EXT:EGF Related Protein CEGP1 Protein-Like

Expression of gene 134929133_EXT was assessed using the primer-probe sets Ag1931, Ag394 and Ag2317, described in Tables AA, AB and AC. Results of the RTQ-PCR runs are shown in Tables AD, AE, AF, AG and AH.

TABLE AA

Probe Name Ag1931

| Primers | Sequences | Length | Start Position | SEQ ID NO |
|---|---|---|---|---|
| Forward | 5'-cacagtggcttcttccttagtg-3' | 22 | 530 | 169 |
| Probe | TET-5'-catccaccgctccaatgagggtat-3'-TAMRA | 24 | 568 | 170 |
| Reverse | 5'-atggtctttgttcatgcagttc-3' | 22 | 592 | 171 |

TABLE AB

Probe Name Ag394

| Primers | Sequences | Length | Start Position | SEQ ID NO |
|---|---|---|---|---|
| Forward | 5'-cagtgccacagtggcttcttc-3' | 21 | 524 | 172 |
| Probe | TET-5'-agtgacaaccagcatacctgcatccacc-3'-TAMRA | 28 | 548 | 173 |
| Reverse | 5'-tgcagttcatacctcattgga-3' | 22 | 578 | 174 |

TABLE AC

Probe Name Ag2317

| Primers | Sequences | Length | Start Position | SEQ ID NO |
|---|---|---|---|---|
| Forward | 5'-cacagtggcttcttccttagtg-3' | 22 | 530 | 175 |
| Probe | TET-5'-atacctgcatccaccgctccaatgag-3'-TAMRA | 26 | 561 | 176 |
| Reverse | 5'-ggtctttgttcatgcagttcat-3' | 22 | 590 | 177 |

TABLE AD

CNS_neurodegeneration_v1.0

| Tissue Name | Rel. Exp. (%) Ag1931, Run 207807792 | Tissue Name | Rel. Exp. (%) Ag1931, Run 207807792 |
| --- | --- | --- | --- |
| AD 1 Hippo | 16.5 | Control (Path) 3 Temporal Ctx | 28.1 |
| AD 2 Hippo | 27.7 | Control (Path) 4 Temporal Ctx | 47.0 |
| AD 3 Hippo | 6.8 | AD 1 Occipital Ctx | 28.1 |
| AD 4 Hippo | 16.5 | AD 2 Occipital Ctx (Missing) | 0.0 |
| AD 5 Hippo | 100.0 | AD 3 Occipital Ctx | 17.9 |
| AD 6 Hippo | 45.1 | AD 4 Occipital Ctx | 25.0 |
| Control 2 Hippo | 37.6 | AD 5 Occipital Ctx | 39.0 |
| Control 4 Hippo | 13.0 | AD 5 Occipital Ctx | 43.5 |
| Control (Path) 3 Hippo | 25.0 | Control 1 Occipital Ctx | 16.4 |
| AD 1 Temporal Ctx | 34.9 | Control 2 Occipital Ctx | 94.6 |
| AD 2 Temporal Ctx | 22.2 | Control 3 Occipital Ctx | 42.6 |
| AD 3 Temporal Ctx | 3.1 | Control 4 Occipital Ctx | 10.2 |
| AD 4 Temporal Ctx | 15.0 | Control (Path) 1 Occipital Ctx | 73.7 |
| AD 5 Inf Temporal Ctx | 71.7 | Control (Path) 2 Occipital Ctx | 20.0 |
| AD 5 Sup Temporal Ctx | 40.3 | Control (Path) 3 Occipital Ctx | 24.3 |
| AD 6 Inf Temporal Ctx | 29.3 | Control (Path) 4 Occipital Ctx | 34.4 |
| AD 6 Sup Temporal Ctx | 21.5 | Control 1 Parietal Ctx | 18.3 |
| Control 1 Temporal Ctx | 10.9 | Control 2 Parietal Ctx | 67.8 |
| Control 2 Temporal Ctx | 28.1 | Control 3 Parietal Ctx | 23.8 |
| Control 3 Temporal Ctx | 15.3 | Control (Path) 1 Parietal Ctx | 42.3 |
| Control 3 Temporal Ctx | 0.0 | Control (Path) 2 Parietal Ctx | 30.1 |
| Control (Path) 1 Temporal Ctx | 18.3 | Control (Path) 3 Parietal Ctx | 37.1 |
| Control (Path) 2 Temporal Ctx | 22.1 | Control (Path) 4 Parietal Ctx | 39.8 |

TABLE AE

Panel 1

| Tissue Name | Rel. Exp. (%) Ag394, Run 91010047 | Tissue Name | Rel. Exp. (%) Ag394, Run 91010047 |
| --- | --- | --- | --- |
| Endothelial cells | 0.0 | Renal ca. 786-0 | 0.0 |
| Endothelial cells (treated) | 0.2 | Renal ca. A498 | 0.0 |
| Pancreas | 0.0 | Renal ca. RXF 393 | 0.0 |
| Pancreatic ca. CAPAN 2 | 0.0 | Renal ca. ACHN | 0.0 |
| Adrenal gland | 6.3 | Renal ca. UO-31 | 0.0 |
| Thyroid | 3.1 | Renal ca. TK-10 | 0.0 |
| Salivary gland | 3.5 | Liver | 0.0 |
| Pituitary gland | 0.0 | Liver (fetal) | 0.0 |
| Brain (fetal) | 20.3 | Liver ca. (hepatoblast) HepG2 | 0.0 |
| Brain (whole) | 1.9 | Lung | 11.8 |
| Brain (amygdala) | 0.4 | Lung (fetal) | 2.8 |
| Brain (cerebellum) | 0.1 | Lung ca. (small cell) LX-1 | 0.0 |
| Brain (hippocampus) | 0.2 | Lung ca. (small cell) NCI-H69 | 0.0 |
| Brain (substantia nigra) | 9.2 | Lung ca. (s. cell var.) SHP-77 | 25.2 |
| Brain (thalamus) | 0.0 | Lung ca. (large cell)NCI-H460 | 6.1 |
| Brain (hypothalamus) | 4.7 | Lung ca. (non-sm. cell) A549 | 0.0 |
| Spinal cord | 6.4 | Lung ca. (non-s. cell) NCI-H23 | 0.0 |
| glio/astro U87-MG | 0.0 | Lung ca. (non-s. cell) HOP-62 | 0.0 |
| glio/astro U-118-MG | 0.0 | Lung ca. (non-s. cl) NCI-H522 | 0.0 |
| astrocytoma SW1783 | 0.0 | Lung ca. (squam.) SW 900 | 0.0 |
| neuro*; met SK-N-AS | 0.0 | Lung ca. (squam.) NCI- | 0.0 |

TABLE AE-continued

Panel 1

| Tissue Name | Rel. Exp. (%) Ag394, Run 91010047 | Tissue Name | Rel. Exp. (%) Ag394, Run 91010047 |
|---|---|---|---|
| | | H596 | |
| astrocytoma SF-539 | 13.3 | Mammary gland | 7.1 |
| astrocytoma SNB-75 | 25.9 | Breast ca.* (pl. ef) MCF-7 | 0.0 |
| glioma SNB-19 | 0.0 | Breast ca.* (pl. ef) MDA-MB-231 | 0.0 |
| glioma U251 | 0.0 | Breast ca.* (pl. ef) T47D | 0.0 |
| glioma SF-295 | 4.3 | Breast ca. BT-549 | 0.0 |
| Heart | 0.0 | Breast ca. MDA-N | 0.0 |
| Skeletal muscle | 0.0 | Ovary | 65.5 |
| Bone marrow | 2.5 | Ovarian ca. OVCAR-3 | 0.0 |
| Thymus | 0.0 | Ovarian ca. OVCAR-4 | 0.0 |
| Spleen | 9.2 | Ovarian ca. OVCAR-5 | 0.0 |
| Lymph node | 0.0 | Ovarian ca. OVCAR-8 | 0.0 |
| Colon (ascending) | 7.0 | Ovarian ca. IGROV-1 | 0.0 |
| Stomach | 15.2 | Ovarian ca. (ascites) SK-OV-3 | 0.0 |
| Small intestine | 16.3 | Uterus | 7.2 |
| Colon ca. SW480 | 0.0 | Placenta | 9.6 |
| Colon ca.* SW620 (SW480 met) | 0.0 | Prostate | 1.9 |
| Colon ca. HT29 | 0.0 | Prostate ca.* (bone met) PC-3 | 0.0 |
| Colon ca. HCT-116 | 0.9 | Testis | 100.0 |
| Colon ca. CaCo-2 | 0.0 | Melanoma Hs688(A).T | 0.0 |
| Colon ca. HCT-15 | 0.0 | Melanoma* (met) Hs688(B).T | 0.0 |
| Colon ca. HCC-2998 | 0.0 | Melanoma UACC-62 | 0.0 |
| Gastric ca. (liver met) NCI-N87 | 0.0 | Melanoma M14 | 0.0 |
| Bladder | 3.6 | Melanoma LOX IMVI | 0.0 |
| Trachea | 6.7 | Melanoma* (met) SK-MEL-5 | 0.0 |
| Kidney | 4.3 | Melanoma SK-MEL-28 | 0.0 |
| Kidney (fetal) | 6.5 | | |

TABLE AF

Panel 1.3D

| Tissue Name | Rel. Exp. (%) Ag2317, Run 159204267 | Rel. Exp. (%) Ag394, Run 165678153 | Tissue Name | Rel. Exp. (%) Ag2317, Run 159204267 | Rel. Exp. (%) Ag394, Run 165678153 |
|---|---|---|---|---|---|
| Liver adenocarcinoma | 0.0 | 0.0 | Kidney (fetal) | 2.6 | 2.7 |
| Pancreas | 0.4 | 0.0 | Renal ca. 786-0 | 0.0 | 0.0 |
| Pancreatic ca. CAPAN 2 | 0.1 | 0.6 | Renal ca. A498 | 33.2 | 45.7 |
| Adrenal gland | 5.2 | 7.4 | Renal ca. RXF 393 | 0.0 | 0.0 |
| Thyroid | 2.7 | 1.7 | Renal ca. ACHN | 0.0 | 0.0 |
| Salivary gland | 0.9 | 1.3 | Renal ca. UO-31 | 0.1 | 0.0 |
| Pituitary gland | 3.5 | 1.6 | Renal ca. TK-10 | 0.0 | 0.0 |
| Brain (fetal) | 15.5 | 33.2 | Liver | 4.3 | 18.6 |
| Brain (whole) | 0.4 | 1.5 | Liver (fetal) | 0.0 | 0.0 |
| Brain (amygdala) | 0.9 | 2.8 | Liver ca. (hepatoblast) HepG2 | 0.0 | 0.0 |
| Brain (cerebellum) | 0.1 | 0.0 | Lung | 9.5 | 6.7 |
| Brain (hippocampus) | 5.4 | 1.1 | Lung (fetal) | 1.5 | 4.0 |
| Brain (substantia nigra) | 0.8 | 14.0 | Lung ca. (small cell) LX-1 | 0.0 | 0.5 |
| Brain (thalamus) | 0.3 | 1.1 | Lung ca. (small cell) NCI-H69 | 0.2 | 0.6 |
| Cerebral Cortex | 1.8 | 1.5 | Lung ca. (s.cell var.) SHP-77 | 16.8 | 17.2 |
| Spinal cord | 2.9 | 7.4 | Lung ca. (large cell)NCI-H460 | 1.3 | 9.6 |
| glio/astro U87- | 0.4 | 1.2 | Lung ca. (non- | 0.0 | 0.0 |

TABLE AF-continued

Panel 1.3D

| Tissue Name | Rel. Exp. (%) Ag2317, Run 159204267 | Rel. Exp. (%) Ag394, Run 165678153 | Tissue Name | Rel. Exp. (%) Ag2317, Run 159204267 | Rel. Exp. (%) Ag394, Run 165678153 |
|---|---|---|---|---|---|
| MG | | | sm. cell) A549 | | |
| glio/astro U-118-MG | 0.0 | 0.0 | Lung ca. (non-s.cell) NCI-H23 | 0.0 | 0.5 |
| astrocytoma SW1783 | 0.0 | 0.0 | Lung ca. (non-s.cell) HOP-62 | 0.2 | 0.0 |
| neuro*; met SK-N-AS | 2.5 | 2.0 | Lung ca. (non-s.cl) NCI-H522 | 0.2 | 0.0 |
| astrocytoma SF-539 | 16.4 | 23.3 | Lung ca. (squam.) SW 900 | 0.0 | 0.0 |
| astrocytoma SNB-75 | 45.4 | 100.0 | Lung ca. (squam.) NCI-H596 | 0.0 | 0.5 |
| glioma SNB-19 | 0.0 | 0.0 | Mammary gland | 2.5 | 3.0 |
| glioma U251 | 0.2 | 0.0 | Breast ca.* (pl.ef) MCF-7 | 0.0 | 0.4 |
| glioma SF-295 | 3.1 | 4.9 | Breast ca.* (pl.ef) MDA-MB-231 | 0.0 | 0.0 |
| Heart (Fetal) | 0.0 | 0.0 | Breast ca.* (pl. ef) T47D | 0.0 | 0.0 |
| Heart | 0.1 | 1.0 | Breast ca. BT-549 | 0.0 | 0.0 |
| Skeletal muscle (Fetal) | 1.2 | 0.0 | Breast ca. MDA-N | 0.0 | 0.0 |
| Skeletal muscle | 0.0 | 3.6 | Ovary | 100.0 | 30.4 |
| Bone marrow | 1.7 | 1.5 | Ovarian ca. OVCAR-3 | 0.0 | 1.7 |
| Thymus | 0.1 | 0.3 | Ovarian ca. OVCAR-4 | 0.0 | 0.0 |
| Spleen | 10.3 | 10.2 | Ovarian ca. OVCAR-5 | 0.0 | 0.0 |
| Lymph node | 0.6 | 1.1 | Ovarian ca. OVCAR-8 | 0.0 | 0.0 |
| Colorectal | 4.9 | 2.6 | Ovarian ca. IGROV-1 | 0.0 | 0.0 |
| Stomach | 3.3 | 5.4 | Ovarian ca. (ascites) SK-OV-3 | 0.0 | 0.0 |
| Small intestine | 12.0 | 27.4 | Uterus | 0.1 | 0.2 |
| Colon ca. SW480 | 0.0 | 0.0 | Placenta | 2.3 | 1.4 |
| Colon ca.* SW620 (SW480 met) | 0.0 | 0.0 | Prostate | 0.5 | 0.2 |
| Colon ca. HT29 | 0.0 | 0.0 | Prostate ca.* (bone met) PC-3 | 0.0 | 0.0 |
| Colon ca. HCT-116 | 0.7 | 2.7 | Testis | 13.6 | 10.7 |
| Colon ca. CaCo-2 | 0.0 | 0.0 | Melanoma Hs688(A).T | 0.0 | 0.0 |
| CC Well to Mod Diff (ODO3866) | 0.3 | 0.2 | Melanoma* (met) Hs688(B).T | 0.0 | 0.0 |
| Colon ca. HCC-2998 | 0.0 | 0.0 | Melanoma UACC-62 | 0.0 | 0.0 |
| Gastric ca. (liver met) NCI-N87 | 0.0 | 0.0 | Melanoma M14 | 0.0 | 0.0 |
| Bladder | 0.1 | 0.2 | Melanoma LOX IMVI | 0.0 | 0.0 |
| Trachea | 12.9 | 9.4 | Melanoma* (met) SK-MEL-5 | 0.3 | 1.6 |
| Kidney | 1.5 | 6.4 | Adipose | 2.0 | 3.0 |

TABLE AG

Panel 2D

| Tissue Name | Rel. Exp. (%) Ag2317, Run 159204970 | Tissue Name | Rel. Exp. (%) Ag2317, Run 159204970 |
|---|---|---|---|
| Normal Colon | 33.9 | Kidney Margin 8120608 | 17.4 |
| CC Well to Mod Diff (ODO3866) | 0.3 | Kidney Cancer 8120613 | 0.0 |
| CC Margin (ODO3866) | 9.2 | Kidney Margin 8120614 | 24.3 |

TABLE AG-continued

Panel 2D

| Tissue Name | Rel. Exp. (%) Ag2317, Run 159204970 | Tissue Name | Rel. Exp. (%) Ag2317, Run 159204970 |
|---|---|---|---|
| CC Gr.2 rectosigmoid (ODO3868) | 1.1 | Kidney Cancer 9010320 | 9.3 |
| CC Margin (ODO3868) | 1.0 | Kidney Margin 9010321 | 14.7 |
| CC Mod Diff (ODO3920) | 8.2 | Normal Uterus | 0.2 |
| CC Margin (ODO3920) | 8.2 | Uterine Cancer 064011 | 3.3 |
| CC Gr.2 ascend colon (ODO3921) | 19.2 | Normal Thyroid | 9.2 |
| CC Margin (ODO3921) | 14.9 | Thyroid Cancer | 0.4 |
| CC from Partial Hepatectomy (ODO4309) Mets | 3.1 | Thyroid Cancer A302152 | 0.2 |
| Liver Margin (ODO4309) | 4.4 | Thyroid Margin A302153 | 4.7 |
| Colon mets to lung (OD04451-01) | 7.4 | Normal Breast | 8.5 |
| Lung Margin (OD04451-02) | 23.7 | Breast Cancer | 2.6 |
| Normal Prostate 6546-1 | 0.6 | Breast Cancer (OD04590-01) | 2.2 |
| Prostate Cancer (OD04410) | 1.4 | Breast Cancer Mets (OD04590-03) | 1.8 |
| Prostate Margin (OD04410) | 6.7 | Breast Cancer Metastasis | 1.6 |
| Prostate Cancer (OD04720-01) | 3.0 | Breast Cancer | 3.3 |
| Prostate Margin (OD04720-02) | 3.5 | Breast Cancer | 2.8 |
| Normal Lung | 33.0 | Breast Cancer 9100266 | 71.2 |
| Lung Met to Muscle (ODO4286) | 0.6 | Breast Margin 9100265 | 21.2 |
| Muscle Margin (ODO4286) | 1.1 | Breast Cancer A209073 | 3.9 |
| Lung Malignant Cancer (OD03126) | 5.6 | Breast Margin A2090734 | 3.9 |
| Lung Margin (OD03126) | 62.9 | Normal Liver | 11.0 |
| Lung Cancer (OD04404) | 2.9 | Liver Cancer | 0.0 |
| Lung Margin (OD04404) | 23.3 | Liver Cancer 1025 | 10.5 |
| Lung Cancer (OD04565) | 0.6 | Liver Cancer 1026 | 42.6 |
| Lung Margin (OD04565) | 17.2 | Liver Cancer 6004-T | 13.0 |
| Lung Cancer (OD04237-01) | 3.7 | Liver Tissue 6004-N | 0.8 |
| Lung Margin (OD04237-02) | 50.3 | Liver Cancer 6005-T | 30.8 |
| Ocular Mel Met to Liver (ODO4310) | 0.2 | Liver Tissue 6005-N | 5.5 |
| Liver Margin (ODO4310) | 0.2 | Normal Bladder | 4.2 |
| Melanoma Metastasis | 0.3 | Bladder Cancer | 1.7 |
| Lung Margin (OD04321) | 77.9 | Bladder Cancer | 0.8 |
| Normal Kidney | 28.9 | Bladder Cancer (OD04718-01) | 0.4 |
| Kidney Ca, Nuclear grade 2 (OD04338) | 4.6 | Bladder Normal Adjacent (OD04718-03) | 1.0 |
| Kidney Margin (OD04338) | 15.6 | Normal Ovary | 100.0 |
| Kidney Ca Nuclear grade 1/2 (OD04339) | 3.2 | Ovarian Cancer | 5.0 |
| Kidney Margin (OD04339) | 31.0 | Ovarian Cancer (OD04768-07) | 0.2 |
| Kidney Ca, Clear cell type (OD04340) | 2.0 | Ovary Margin (OD04768-08) | 0.4 |
| Kidney Margin (OD04340) | 25.9 | Normal Stomach | 50.3 |
| Kidney Ca, Nuclear grade 3 (OD04348) | 0.4 | Gastric Cancer 9060358 | 8.7 |
| Kidney Margin (OD04348) | 16.8 | Stomach Margin 9060359 | 13.6 |
| Kidney Cancer (OD04622-01) | 3.0 | Gastric Cancer 9060395 | 35.1 |
| Kidney Margin (OD04622-03) | 4.8 | Stomach Margin 9060394 | 36.3 |
| Kidney Cancer (OD04450-01) | 1.7 | Gastric Cancer 9060397 | 6.4 |
| Kidney Margin (OD04450-03) | 15.8 | Stomach Margin 9060396 | 13.1 |
| Kidney Cancer 8120607 | 1.6 | Gastric Cancer 064005 | 14.2 |

TABLE AH

Panel 4D

| Tissue Name | Rel. Exp. (%) Ag2317, Run 159205749 | Tissue Name | Rel. Exp. (%) Ag2317, Run 159205749 |
|---|---|---|---|
| Secondary Th1 act | 0.0 | HUVEC IL-1beta | 0.0 |
| Secondary Th2 act | 0.5 | HUVEC IFN gamma | 0.6 |
| Secondary Tr1 act | 0.0 | HUVEC TNF alpha + IFN gamma | 1.8 |
| Secondary Th1 rest | 0.8 | HUVEC TNF alpha + IL4 | 0.0 |
| Secondary Th2 rest | 0.0 | HUVEC IL-11 | 0.5 |
| Secondary Tr1 rest | 0.0 | Lung Microvascular EC none | 0.8 |
| Primary Th1 act | 0.0 | Lung Microvascular EC TNF alpha + IL-1beta | 0.6 |
| Primary Th2 act | 0.0 | Microvascular Dermal EC none | 0.7 |
| Primary Tr1 act | 0.0 | Microvasular Dermal EC TNF alpha + IL-1beta | 0.0 |
| Primary Th1 rest | 0.0 | Bronchial epithelium TNF alpha + IL1beta | 0.0 |
| Primary Th2 rest | 0.0 | Small airway epithelium none | 0.0 |
| Primary Tr1 rest | 0.0 | Small airway epithelium TNF alpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNF alpha + IL-1beta | 0.0 |
| CD8 lymphocyte act | 0.0 | Astrocytes rest | 0.0 |
| Secondary CD8 lymphocyte rest | 0.0 | Astrocytes TNF alpha + IL-1beta | 0.0 |
| Secondary CD8 lymphocyte act | 0.0 | KU-812 (Basophil) rest | 0.4 |
| CD4 lymphocyte none | 0.6 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 1.7 | CCD1106 (Keratinocytes) TNF alpha + IL-1beta | 0.0 |
| LAK cells IL-2 | 1.5 | Liver cirrhosis | 0.0 |
| LAK cells IL-2 + IL-12 | 0.6 | Lupus kidney | 5.3 |
| LAK cells IL-2 + IFN gamma | 1.3 | NCI-H292 none | 0.0 |
| LAK cells IL-2 + IL-18 | 1.4 | NCI-H292 IL-4 | 0.0 |
| LAK cells PMA/ionomycin | 0.6 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1beta | 0.0 |
| PBMC rest | 0.0 | Lung fibroblast none | 0.7 |
| PBMC PWM | 0.0 | Lung fibroblast TNF alpha + IL-1beta | 0.0 |
| PBMC PHA-L | 0.0 | Lung fibroblast IL-4 | 6.3 |
| Ramos (B cell) none | 0.0 | Lung fibroblast IL-9 | 0.3 |
| Ramos (B cell) ionomycin | 0.0 | Lung fibroblast IL-13 | 2.9 |
| B lymphocytes PWM | 0.7 | Lung fibroblast IFN gamma | 6.2 |
| B lymphocytes CD40L and IL-4 | 0.6 | Dermal fibroblast CCD1070 rest | 0.5 |
| EOL-1 dbcAMP | 1.1 | Dermal fibroblast CCD1070 TNF alpha | 0.0 |
| EOL-1 dbcAMP PMA/ionomycin | 0.0 | Dermal fibroblast CCD1070 IL-1beta | 0.0 |
| Dendritic cells none | 0.0 | Dermal fibroblast IFN gamma | 0.0 |
| Dendritic cells LPS | 1.6 | Dermal fibroblast IL-4 | 0.0 |
| Dendritic cells anti-CD40 | 0.4 | IBD Colitis 2 | 0.7 |
| Monocytes rest | 1.6 | IBD Crohn's | 10.4 |
| Monocytes LPS | 1.4 | Colon | 80.7 |
| Macrophages rest | 0.4 | Lung | 47.0 |
| Macrophages LPS | 0.0 | Thymus | 100.0 |
| HUVEC none | 0.0 | Kidney | 2.0 |
| HUVEC starved | 1.2 | | |

CNS_neurodegeneration_v1.0 Summary: Ag1931 While this gene does not show differential expression between Alzheimer's diseased and control brains, this panel confirms the expression of this gene in the brains of an additional group of patients. Please see Panel 1.3D for discussion of utility in the central nervous system.

Panel 1 Summary: Ag394 This gene is expressed predominantly in healthy tissues, with highest expression in the testis (CT=25.6). It is also expressed at significant levels in the prostate, uterus, placenta, and ovary. This gene encodes a protein with homology to the EGF related Protein CEGP1. The expression profile of this gene suggests that the protein product may be involved in the normal functioning of these organs and specifically in reproduction. Thus, therapeutic modulation of the expression or function of this gene may be of use to treat diseases of the testis or reproduction, such as infertility.

Among tissues with metabolic function, this gene is expresssed at moderate levels in the adrenal and thyroid glands. Thus, the protein encoded by this gene may be a protein therapeutic for the treatment of disease in these tissues.

The expression in the central nervous system in this panel confirms that this gene product is present in the brain. Please see Panel 1.3D for discussion of potential utility in the central nervous system.

Panel 1.3D Summary: Ag394/Ag2317 Two experiments with two different probe and primer sets show highest expression of this gene in the ovary and in a cell line derived from an astrocytoma(CTs=28). The concordance of the expression profiles between the two runs is very good, with low but significant expression also seen in the testis. Significant expression in the ovary and testis is also seen in Panel 1 and suggests that the protein product may play a role in reproduction. Thus, therapeutic modulation of the expression or function of this gene may be effective in the treatment of infertility.

This gene shows a moderately increased level of expression in the astrocytoma cell lines SNB-75 and SF-539 compared to normal brain tissue, as well as a renal cancer cell line (A498) compared to normal adult kidney tissue. Thus, the expression of this gene could be used as a marker for different grades/types of the kidney or brain cancers which were used in the derivation of these cell lines. Furthermore, inhibition of the activity of the product of this gene, through the use of antibodies may be useful in the therapy of cancer. In addition, a number of cancer cell lines (colon, lung, breast, ovary) appear to have lost the ability to express this gene compared to the normal tissue. Hence, in those tissues, loss of expression could potentially serve as a marker for cancer. Therefore, therapeutic use of the product of this gene, through the use of peptides or proteins may be useful in the treatment of these cancers.

This gene is a homolog of EGF related Protein CEGP1, and is expressed at moderate levels in the fetal brain, and at low levels in the adult hippocampus, cortex, and spinal cord. This expression profile suggests that treatment with this protein may enhance neurite outgrowth or synaptogenesis, and may be beneficial in the treatment of any disorder involving neural death (Alzheimer's, Parkinson's, Huntington's, stroke, head or spinal cord trauma, or spinocerebellar ataxia).

A novel EGF-related gene, Scubel (signal peptide-CUB domain-EGF-related, gene 1) is expressed prominently in the developing gonad, nervous system, somites, surface ectoderm and limb buds of the mouse. See Grimmond, S., et al., *Mech. Dev.,* 2001 April; 102(1–2): 209–11. The expression pattern of a closely related gene, Scube2 (also known as Cegp1), which maps to the distal region of mouse chromosome 7 is disclosed in this invention. Scube2 transcription is restricted to the embryonic neurectoderm but is also detectable in the adult heart, lung and testis.

Panel 2D Summary: Ag2317

The highest level of expression is seen in normal ovary (CT=28.97). It is expressed at a higher level in normal tissue than the adjacent tumor tissue in ovary, bladder, thyroid, kidney and lung. This selective pattern of expression in normal tissue is also seen in Panel 1. Thus, the lack of expression of this gene could be of use as a marker for ovarian, bladder, thyroid, lung, kidney and some forms of breast cancer. In addition, therapeutic activity of the product of this gene, through the use of peptides, the protein, chimeric molecules or small molecule drugs, may be useful in the therapy of these cancers.

Since there is moderately increased expression in liver tumor tissue compared to normal adjacent tissue, this gene may also serve as a marker for liver cancer. Therefore, inhibition of the product of this gene might be effective in the treatment of liver and breast cancers.

Panel 4D Summary: Ag2317 This SCUBE-like protein is expressed in the thymus, lung, and colon with lower expression detected in Crohn's disease and in 2 samples of ulcerative colitis. The protein contains 10 EGF domains and one CUB domain, and is likely a secreted protein (with a weak signal peptide) produced by normal intestine. This SCUBE-like protein may be a protein therapeutic for the reduction or elimination of symptoms in patients with Crohn's disease or ulcerative colitis.

B. NOV10

28477694_A: Faciogenital Dysplasia Protein-Like

Expression of gene 28477694_A was assessed using the primer-probe set Ag2314, described in Table BA. Results of the RTQ-PCR runs are shown in Tables BB, BC, BD and BE.

TABLE BA

Probe Name Ag2314

| Primers | Sequences | Length | Start Position | SEQ ID NO |
|---|---|---|---|---|
| Forward | 5'-actcttccaggaggttctcact-3' | 22 | 678 | 178 |
| Probe | TET-5'-ctgaccctgcagcaccacatgct-3'-TAMRA | 23 | 730 | 179 |
| Reverse | 5'-gtggaattctctgcactggtt-3' | 21 | 755 | 180 |

TABLE BB

CNS_neurodegeneration_v1.0

| Tissue Name | Rel. Exp. (%) Ag2314, Run 208253896 | Tissue Name | Rel. Exp. (%) Ag2314, Run 208253896 |
|---|---|---|---|
| AD 1 Hippo | 24.1 | Control (Path) 3 Temporal Ctx | 6.5 |
| AD 2 Hippo | 39.2 | Control (Path) 4 Temporal Ctx | 15.9 |
| AD 3 Hippo | 19.8 | AD 1 Occipital Ctx | 2.1 |
| AD 4 Hippo | 13.0 | AD 2 Occipital Ctx (Missing) | 0.0 |
| AD 5 Hippo | 56.3 | AD 3 Occipital Ctx | 3.2 |
| AD 6 Hippo | 100.0 | AD 4 Occipital Ctx | 15.6 |
| Control 2 Hippo | 59.0 | AD 5 Occipital Ctx | 7.4 |
| Control 4 Hippo | 33.4 | AD 5 Occipital Ctx | 20.9 |
| Control (Path) 3 Hippo | 7.6 | Control 1 Occipital Ctx | 7.6 |
| AD 1 Temporal Ctx | 23.5 | Control 2 Occipital Ctx | 28.9 |
| AD 2 Temporal Ctx | 24.5 | Control 3 Occipital Ctx | 13.9 |
| AD 3 Temporal Ctx | 6.6 | Control 4 Occipital Ctx | 10.9 |
| AD 4 Temporal Ctx | 23.2 | Control (Path) 1 Occipital Ctx | 17.6 |
| AD 5 Inf Temporal Ctx | 59.0 | Control (Path) 2 Occipital Ctx | 7.5 |
| AD 5 Sup Temporal Ctx | 87.1 | Control (Path) 3 Occipital Ctx | 2.2 |
| AD 6 Inf Temporal Ctx | 85.3 | Control (Path) 4 Occipital Ctx | 14.1 |
| AD 6 Sup Temporal Ctx | 70.7 | Control 1 Parietal Ctx | 12.7 |
| Control 1 Temporal Ctx | 18.2 | Control 2 Parietal Ctx | 76.8 |
| Control 2 Temporal Ctx | 33.4 | Control 3 Parietal Ctx | 18.6 |
| Control 3 Temporal Ctx | 21.5 | Control (Path) 1 Parietal Ctx | 15.3 |
| Control 3 Temporal Ctx | 8.7 | Control (Path) 2 Parietal Ctx | 7.8 |
| Control (Path) 1 Temporal Ctx | 26.4 | Control (Path) 3 Parietal Ctx | 1.3 |
| Control (Path) 2 Temporal Ctx | 18.9 | Control (Path) 4 Parietal Ctx | 27.2 |

TABLE BC

Panel 1.3D

| Tissue Name | Rel. Exp. (%) Ag2314, Run 165975013 | Tissue Name | Rel. Exp. (%) Ag2314, Run 165975013 |
|---|---|---|---|
| Liver adenocarcinoma | 0.0 | Kidney (fetal) | 2.2 |
| Pancreas | 4.5 | Renal ca. 786-0 | 0.0 |
| Pancreatic ca. CAPAN 2 | 2.3 | Renal ca. A498 | 0.0 |
| Adrenal gland | 15.2 | Renal ca. RXF 393 | 0.0 |
| Thyroid | 8.8 | Renal ca. ACHN | 0.0 |
| Salivary gland | 20.3 | Renal ca. UO-31 | 0.0 |
| Pituitary gland | 2.2 | Renal ca. TK-10 | 0.0 |
| Brain (fetal) | 4.8 | Liver | 7.7 |
| Brain (whole) | 32.3 | Liver (fetal) | 5.8 |
| Brain (amygdala) | 18.9 | Liver ca. (hepatoblast) HepG2 | 0.0 |
| Brain (cerebellum) | 13.0 | Lung | 34.4 |
| Brain (hippocampus) | 14.8 | Lung (fetal) | 33.7 |
| Brain (substantia nigra) | 19.3 | Lung ca. (small cell) LX-1 | 0.0 |
| Brain (thalamus) | 36.9 | Lung ca. (small cell) NCI-H69 | 0.0 |
| Cerebral Cortex | 7.7 | Lung ca. (s. cell var.) SHP-77 | 0.0 |
| Spinal cord | 38.4 | Lung ca. (large cell)NCI-H460 | 0.0 |
| glio/astro U87-MG | 0.0 | Lung ca. (non-sm. cell) A549 | 0.0 |
| glio/astro U-118-MG | 0.0 | Lung ca. (non-s. cell) NCI-H23 | 0.0 |
| astrocytoma SW1783 | 0.0 | Lung ca. (non-s. cell) HOP-62 | 0.0 |
| neuro*; met SK-N-AS | 0.0 | Lung ca. (non-s. cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 4.2 |
| glioma U251 | 0.0 | Breast ca.* (pl. ef) MCF-7 | 0.0 |
| glioma SF-295 | 0.0 | Breast ca.* (pl. ef) MDA-MB-231 | 0.0 |
| Heart (fetal) | 9.2 | Breast ca.* (pl. ef) T47D | 0.0 |
| Heart | 3.8 | Breast ca. BT-549 | 0.0 |
| Skeletal muscle (Fetal) | 7.3 | Breast ca. MDA-N | 0.0 |
| Skeletal muscle | 2.2 | Ovary | 10.9 |
| Bone marrow | 35.4 | Ovarian ca. OVCAR-3 | 0.0 |

TABLE BC-continued

Panel 1.3D

| Tissue Name | Rel. Exp. (%) Ag2314, Run 165975013 | Tissue Name | Rel. Exp. (%) Ag2314, Run 165975013 |
|---|---|---|---|
| Thymus | 26.1 | Ovarian ca. OVCAR-4 | 0.0 |
| Spleen | 85.9 | Ovarian ca. OVCAR-5 | 0.0 |
| Lymph node | 100.0 | Ovarian ca. OVCAR-8 | 0.0 |
| Colorectal | 19.9 | Ovarian ca. IGROV-1 | 0.0 |
| Stomach | 30.4 | Ovarian ca. (ascites) SK-OV-3 | 0.0 |
| Small intestine | 40.3 | Uterus | 1.8 |
| Colon ca. SW480 | 0.0 | Placenta | 18.4 |
| Colon ca.* SW620 (SW480 met) | 0.0 | Prostate | 0.0 |
| Colon ca. HT29 | 0.0 | Prostate ca.* (bone met) PC-3 | 0.3 |
| Colon ca. HCT-116 | 0.0 | Testis | 2.5 |
| Colon ca. CaCo-2 | 0.0 | Melanoma Hs688(A).T | 0.0 |
| CC Well to Mod Diff (ODO3866) | 14.3 | Melanoma* (met) Hs688(B).T | 0.0 |
| Colon ca. HCC-2998 | 0.0 | Melanoma UACC-62 | 0.0 |
| Gastric ca. (liver met) NCI-N87 | 1.1 | Melanoma M14 | 0.0 |
| Bladder | 20.4 | Melanoma LOX IMVI | 0.0 |
| Trachea | 17.0 | Melanoma* (met) SK-MEL-5 | 0.0 |
| Kidney | 5.0 | Adipose | 18.0 |

TABLE BD

Panel 2.2

| Tissue Name | Rel. Exp. (%) Ag2314, Run 174416264 | Tissue Name | Rel. Exp. (%) Ag2314, Run 174416264 |
|---|---|---|---|
| Normal Colon | 15.7 | Kidney Margin (OD04348) | 48.0 |
| Colon cancer (OD06064) | 22.7 | Kidney malignant cancer (OD06204B) | 1.2 |
| Colon Margin (OD06064) | 16.8 | Kidney normal adjacent tissue (OD06204E) | 3.2 |
| Colon cancer (OD06159) | 6.7 | Kidney Cancer (OD04450-01) | 1.9 |
| Colon Margin (OD06159) | 18.6 | Kidney Margin (OD04450-03) | 1.0 |
| Colon cancer (OD06297-04) | 2.7 | Kidney Cancer 8120613 | 0.9 |
| Colon Margin (OD06297-015) | 22.2 | Kidney Margin 8120614 | 3.8 |
| CC Gr.2 ascend colon (ODO3921) | 0.9 | Kidney Cancer 9010320 | 15.2 |
| CC Margin (ODO3921) | 11.6 | Kidney Margin 9010321 | 2.4 |
| Colon cancer metastasis (OD06104) | 15.6 | Kidney Cancer 8120607 | 14.8 |
| Lung Margin (OD06104) | 28.3 | Kidney Margin 8120608 | 1.6 |
| Colon mets to lung (OD04451-01) | 12.3 | Normal Uterus | 13.9 |
| Lung Margin (OD04451-02) | 52.1 | Uterine Cancer 064011 | 6.4 |
| Normal Prostate | 1.4 | Normal Thyroid | 11.9 |
| Prostate Cancer (OD04410) | 3.7 | Thyroid Cancer | 3.7 |
| Prostate Margin (OD04410) | 5.0 | Thyroid Cancer A302152 | 10.8 |
| Normal Ovary | 11.0 | Thyroid Margin A302153 | 5.7 |
| Ovarian cancer (OD06283-03) | 27.5 | Normal Breast | 15.6 |
| Ovarian Margin (OD06283-07) | 16.3 | Breast Cancer | 6.6 |
| Ovarian Cancer | 8.8 | Breast Cancer | 4.1 |
| Ovarian cancer (OD06145) | 21.2 | Breast Cancer (OD04590-01) | 14.3 |
| Ovarian Margin (OD06145) | 14.8 | Breast Cancer Mets (OD04590-03) | 13.3 |
| Ovarian cancer (OD06455-03) | 3.0 | Breast Cancer Metastasis | 29.5 |
| Ovarian Margin (OD06455-07) | 5.1 | Breast Cancer | 11.8 |
| Normal Lung | 40.1 | Breast Cancer 9100266 | 4.7 |
| Invasive poor diff. lung adeno (ODO4945-01) | 9.5 | Breast Margin 9100265 | 8.2 |
| Lung Margin (ODO4945-03) | 29.7 | Breast Cancer A209073 | 5.1 |
| Lung Malignant Cancer (OD03126) | 15.4 | Breast Margin A2090734 | 9.3 |
| Lung Margin (OD03126) | 19.3 | Breast cancer (OD06083) | 10.4 |
| Lung Cancer (OD05014A) | 15.4 | Breast cancer node metastasis (OD06083) | 27.5 |
| Lung Margin (OD05014B) | 79.6 | Normal Liver | 10.2 |
| Lung cancer (OD06081) | 5.8 | Liver Cancer 1026 | 10.6 |

TABLE BD-continued

Panel 2.2

| Tissue Name | Rel. Exp. (%) Ag2314, Run 174416264 | Tissue Name | Rel. Exp. (%) Ag2314, Run 174416264 |
|---|---|---|---|
| Lung Margin (OD06081) | 29.5 | Liver Cancer 1025 | 64.2 |
| Lung Cancer (OD04237-01) | 4.8 | Liver Cancer 6004-T | 30.8 |
| Lung Margin (OD04237-02) | 58.6 | Liver Tissue 6004-N | 6.7 |
| Ocular Mel Met to liver (ODO4310) | 1.7 | Liver Cancer 6005-T | 33.7 |
| Liver Margin (ODO4310) | 21.9 | Liver Tissue 6005-N | 100.0 |
| Melanoma Metastasis | 3.3 | Liver Cancer | 9.7 |
| Lung Margin (OD04321) | 30.6 | Normal Bladder | 11.7 |
| Normal Kidney | 2.3 | Bladder Cancer | 8.6 |
| Kidney Ca, Nuclear grade 2 (OD04338) | 18.0 | Bladder Cancer | 13.0 |
| Kidney Margin (OD04338) | 17.3 | Normal Stomach | 31.0 |
| Kidney Ca Nuclear grade 1/2 (OD04339) | 23.2 | Gastric Cancer 9060397 | 9.5 |
| Kidney Margin (OD04339) | 2.0 | Stomach Margin 9060396 | 23.0 |
| Kidney Ca, Clear cell type (OD04340) | 9.3 | Gastric Cancer 9060395 | 17.3 |
| Kidney Margin (OD04340) | 8.0 | Stomach Margin 9060394 | 35.6 |
| Kidney Ca, Nuclear grade 3 (OD04348) | 20.7 | Gastric Cancer 064005 | 6.3 |

TABLE BE

Panel 4D

| Tissue Name | Rel. Exp. (%) Ag2314, Run 163975874 | Tissue Name | Rel. Exp. (%) Ag2314, Run 163975874 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.1 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNF alpha + IL-1beta | 0.0 |
| Primary Th2 act | 0.0 | Microvascular Dermal EC none | 0.0 |
| Primary Tr1 act | 0.0 | Microsvasular Dermal EC TNF alpha + IL-1beta | 0.0 |
| Primary Th1 rest | 0.1 | Bronchial epithelium TNF alpha + IL1beta | 0.0 |
| Primary Th2 rest | 0.0 | Small airway epithelium none | 0.0 |
| Primary Tr1 rest | 0.0 | Small airway epithelium TNF alpha + IL-1beta | 1.0 |
| CD45RA CD4 lymphocyte act | 0.3 | Coronery artery SMC rest | 100.0 |
| CD45RO CD4 lymphocyte act | 0.1 | Coronery artery SMC TNF alpha + IL-1beta | 0.0 |
| CD8 lymphocyte act | 0.1 | Astrocytes rest | 0.0 |
| Secondary CD8 lymphocyte rest | 0.1 | Astrocytes TNF alpha + IL-1beta | 0.0 |
| Secondary CD8 lymphocyte act | 0.1 | KU-812 (Basophil) rest | 0.0 |
| CD4 lymphocyte none | 0.4 | KU-812 (Basophil) PMA/ionomycin | 0.0 |
| 2ry Th1/Th2/Tr1_anti-CD95CH11 | 0.0 | CCD1106 (Keratinocytes) none | 0.0 |
| LAK cells rest | 5.3 | CCD1106 (Keratinocytes) TNF alpha + IL-1beta | 0.0 |
| LAK cells IL-2 | 1.0 | Liver cirrhosis | 0.2 |
| LAK cells IL-2 + IL-12 | 0.7 | Lupus kidney | 0.3 |
| LAK cells IL-2 + IFN gamma | 1.3 | NCI-H292 none | 0.0 |
| LAK cells IL-2 + IL-18 | 1.0 | NCI-H292 IL-4 | 0.0 |
| LAK cells PMA/ionomycin | 1.5 | NCI-H292 IL-9 | 0.0 |
| NK Cells IL-2 rest | 0.7 | NCI-H292 IL-13 | 0.0 |
| Two Way MLR 3 day | 7.1 | NCI-H292 IFN gamma | 0.0 |
| Two Way MLR 5 day | 1.7 | HPAEC none | 0.0 |
| Two Way MLR 7 day | 0.4 | HPAEC TNF alpha + IL- | 0.0 |

TABLE BE-continued

Panel 4D

| Tissue Name | Rel. Exp. (%) Ag2314, Run 163975874 | Tissue Name | Rel. Exp. (%) Ag2314, Run 163975874 |
|---|---|---|---|
| | | 1beta | |
| PBMC rest | 6.1 | Lung fibroblast none | 0.0 |
| PBMC PWM | 2.9 | Lung fibroblast TNF alpha + IL-1beta | 0.0 |
| PBMC PHA-L | 2.2 | Lung fibroblast IL-4 | 0.0 |
| Ramos (B cell) none | 0.3 | Lung fibroblast IL-9 | 0.0 |
| Ramos (B cell) ionomycin | 3.1 | Lung fibroblast IL-13 | 0.0 |
| B lymphocytes PWM | 7.2 | Lung fibroblast IFN gamma | 0.0 |
| B lymphocytes CD40L and IL-4 | 9.0 | Dermal fibroblast CCD1070 rest | 0.0 |
| EOL-1 dbcAMP | 1.7 | Dermal fibroblast CCD1070 TNF alpha | 99.3 |
| EOL-1 dbcAMP PMA/ionomycin | 0.2 | Dermal fibroblast CCD1070 IL-1beta | 0.0 |
| Dendritic cells none | 12.0 | Dermal fibroblast IFN gamma | 0.0 |
| Dendritic cells LPS | 14.6 | Dermal fibroblast IL-4 | 0.0 |
| Dendritic cells anti-CD40 | 17.7 | IBD Colitis 2 | 0.8 |
| Monocytes rest | 23.2 | IBD Crohn's | 0.2 |
| Monocytes LPS | 3.6 | Colon | 2.6 |
| Macrophages rest | 6.6 | Lung | 2.1 |
| Macrophages LPS | 7.5 | Thymus | 0.1 |
| HUVEC none | 0.0 | Kidney | 1.8 |
| HUVEC starved | 0.0 | | |

CNS_neurodegeneration_v1.0 Summary: Ag2314 This gene does not show differential expression between Alzheimer's diseased and control brains; however this panel confirms the expression of this gene in the brains of an independent group of patients. Please see Panel 1.3d for discussion of potential utility in the central nervous system.

Panel 1.3D Summary: Ag2314 This gene is expressed predominantly in normnal tissues, with highest expression in the lymph node (CT=30.7). The undetectable levels of expression of this gene in samples derived from cancerous cell lines suggests that this absence of expression could be used as a marker for the presence of cancer. Furthermore, inducing expression of the product of this gene, through the use of peptides, chimeric molecules or small molecule drugs, may be useful in the therapy of melanoma, prostate, ovary, breast, lung, kidney colon, and brain cancers.

This gene is moderately expressed (CT values=33–34) in a variety of metabolic tissues including adrenal, thyroid, fetal heart, fetal skeletal muscle, adult and fetal liver, and adipose. Thus, this gene product may be important in the pathogenesis, diagnosis and/or treatment of metabolic disease in any or all of these tissues, including obesity and diabetes.

This protein is a homolog of the faciogenital dysplasia protein, and is expressed at moderate levels in all brain regions examined. It is a member of the family of guanine nucleotide exchange factors, which play a role in memory formation. Therefore this gene is an excellent drug target for the treatment of Alzheimer's disease or any form of dementia.

Learning, making memories, and forgetting are thought to require changes in the strengths of connections between neurons. Such changes in synaptic strength occur in two phases: an early phase that is likely mediated by covalent modifications to existing proteins, and a delayed phase that depends on new gene expression and protein synthesis. However, the biochemical mechanisms by which neuronal activity leads to changes in synaptic strength are poorly understood. Recently, it has been shown that animals that lack Ras guanine nueleotide releasing factor (Ras-GPF), a Ca(2+)-dependent activator of the small GTP-binding protein, Ras, do not learn fear responses normally, although other types of learning appear normal. These animals show defects in the delayed phase of memory formation within the neuronal circuit that mediates fear conditioning. Recent studies suggest that Ras-GRF couples synaptic activity to the molecular mechanisms that consolidate changes in synaptic strength within specific neuronal circuits. See Finkbeiner, S. and Dalva, M. B., *Bioessays,* 1998 September; 20(9):691–5.

Panel 2.2 Summary: Ag2314 This gene is expressed at a low level in almost all tissues used in this panel. The highest level of expression is seen in normal liver (CT=30.36). The moderately decreased level of expression in lung, uterus and some colon cancers compared to the normal tissues suggests that this decrease could be used as a marker for cancerous tissues. This result is reinforced by the pattern of expression seen in Panel 1.3D, where expression appears to be limited to normal tissue samples.

Panel 4D Summary: Ag2314 This FDG1-like protein is expressed in coronary artery smooth muscle cells, and in TNF-alpha-activated dermal fibroblast CCD1070 cells (CTs=24.6), as well as resting and activated dendritic cells and monocytes. The FDG1 parent molecule is a CDC42 activating molecule and is involved in the regulation of Rho-GTPase. Thus, this gene product may function in a related pathway in dendritic cells and monocytes. Inhibiting the function of the protein encoded by this gene with a small molecule drug in dendritic cells and monocytes may reduce or eliminate inflammation in patients with symptoms consistent with Crohn's disease, ulcerative colitis, rheumatoid arthritis, multiple, sclerosis, asthma, allergy, or lupus erythematosus.

Db1, a guanine nucleotide exchange factor (GEF) for members of the Rho family of small GTPases, is the prototype of a family of 15 related proteins. The majority of proteins that contain a DH (Db1 homology) domain were isolated as oncogenes in transfection assays, but two members of the DH family, FGD1 (the product of the faciogenital dysplasia or Aarskog-Scott syndrome locus) and Vav, have been shown to be essential for normal embryonic development. Mutations to the FGD1 gene result in a human developmental disorder affecting specific skeletal structures, including elements of the face, cervical vertebrae and distal extremities. Homozygous Vav−/− knockout mice embryos are not viable past the blastocyst stage, indicating an essential role of Vav in embryonic implantation. See Olson, M. F., et al., *Curr. Biol.,* 1996 Dec. 1; 6(12):1628–33.

This disclosure shows that the microinjection of FGD1 and Vav into Swiss 3T3 fibroblasts induces the polymerization of actin and the assembly of clustered integrin complexes. FGD1 activates Cdc42, whereas Vav activates Rho, Rac and Cdc42. In addition, FGD1 and Vav stimulate the mitogen activated protein kinase cascade that leads to activation of the c-Jun kinase SAPK/JNK1. Therefore, FGD1 and Vav are regulators of the Rho GTPase family. Along with their target proteins (Cdc42, Rac and Rho), FGD1 and Vav control essential signals required during embryonic development.

C. NOV7

GSAC055715_A: TYPE_II_CYTOKERATIN-Like

Expression of gene GSAC055715_A was assessed using the primer-probe set Ag1855, described in Table CA. Results of the RTQ-PCR runs are shown in Tables CB, CC and CD.

TABLE CA

Probe Name Ag1855

| Primers | Sequences | Length | Start Position | SEQ ID NO |
|---------|-----------|--------|----------------|-----------|
| Forward | 5'-cctcaagtgtctgtatgatgca-3' | 22 | 822 | 181 |
| Probe | TET-5'-cagactcacgccagtgagacctctgt-3'-TAMRA | 26 | 859 | 182 |
| Reverse | 5'-gttgttgtccatggacaggat-3' | 21 | 886 | 183 |

TABLE CB

Panel 1.3D

| Tissue Name | Rel. Exp. (%) Ag1855, Run 160201431 | Tissue Name | Rel. Exp. (%) Ag1855, Run 160201431 |
|---|---|---|---|
| Liver adenocarcinoma | 0.0 | Kidney (fetal) | 0.0 |
| Pancreas | 0.0 | Renal ca. 786-0 | 0.0 |
| Pancreatic ca. CAPAN 2 | 0.0 | Renal ca. A498 | 0.0 |
| Adrenal gland | 0.0 | Renal ca. RXF 393 | 0.0 |
| Thyroid | 0.0 | Renal ca. ACHN | 0.0 |
| Salivary gland | 0.0 | Renal ca. UO-31 | 0.0 |
| Pituitary gland | 0.0 | Renal ca. TK-10 | 0.0 |
| Brain (fetal) | 0.0 | Liver | 0.0 |
| Brain (whole) | 0.0 | Liver (fetal) | 0.0 |
| Brain (amygdala) | 0.0 | Liver ca. (hepatoblast) HepG2 | 0.0 |
| Brain (cerebellum) | 0.0 | Lung | 0.3 |
| Brain (hippocampus) | 0.6 | Lung (fetal) | 0.0 |
| Brain (substantia nigra) | 0.0 | Lung ca. (small cell) LX-1 | 1.8 |
| Brain (thalamus) | 0.0 | Lung ca. (small cell) NCI-H69 | 0.0 |
| Cerebral Cortex | 0.0 | Lung ca. (s. cell var.) SHP-77 | 0.0 |
| Spinal cord | 0.0 | Lung ca. (large cell)NCI-H460 | 0.0 |
| glio/astro U87-MG | 0.0 | Lung ca. (non-sm. cell) A549 | 0.0 |
| glio/astro U-118-MG | 0.0 | Lung ca. (non-s. cell) NCI-H23 | 0.0 |
| astrocytoma SW1783 | 0.0 | Lung ca. (non-s. cell) HOP-62 | 0.0 |
| neuro*; met SK-N-AS | 0.0 | Lung ca. (non-s. cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 0.8 |
| glioma U251 | 0.0 | Breast ca.* (pl. ef) MCF-7 | 0.0 |
| glioma SF-295 | 0.0 | Breast ca.* (pl. ef) MDA-MB-231 | 0.0 |
| Heart (Fetal) | 1.0 | Breast ca.* (pl. ef) T47D | 0.0 |
| Heart | 0.0 | Breast ca. BT-549 | 0.0 |
| Skeletal muscle (Fetal) | 0.0 | Breast ca. MDA-N | 0.0 |
| Skeletal muscle | 0.0 | Ovary | 0.0 |
| Bone marrow | 0.0 | Ovarian ca. OVCAR-3 | 0.0 |

TABLE CB-continued

Panel 1.3D

| Tissue Name | Rel. Exp. (%) Ag1855, Run 160201431 | Tissue Name | Rel. Exp. (%) Ag1855, Run 160201431 |
|---|---|---|---|
| Thymus | 1.1 | Ovarian ca. OVCAR-4 | 0.0 |
| Spleen | 0.0 | Ovarian ca. OVCAR-5 | 0.0 |
| Lymph node | 0.0 | Ovarian ca. OVCAR-8 | 0.0 |
| Colorectal | 0.0 | Ovarian ca. IGROV-1 | 0.0 |
| Stomach | 0.0 | Ovarian ca. (ascites) SK-OV-3 | 0.0 |
| Small intestine | 0.0 | Uterus | 0.0 |
| Colon ca. SW480 | 100.0 | Placenta | 0.0 |
| Colon ca.* SW620 (SW480 met) | 0.0 | Prostate | 0.0 |
| Colon ca. HT29 | 0.0 | Prostate ca.* (bone met) PC-3 | 0.0 |
| Colon ca. HCT-116 | 0.0 | Testis | 1.7 |
| Colon ca. CaCo-2 | 0.0 | Melanoma Hs688(A).T | 0.0 |
| CC Well to Mod Diff (ODO3866) | 1.1 | Melanoma* (met) Hs688(B).T | 0.0 |
| Colon ca. HCC-2998 | 0.0 | Melanoma UACC-62 | 0.0 |
| Gastric ca. (liver met) NCI-N87 | 0.0 | Melanoma M14 | 0.0 |
| Bladder | 0.0 | Melanoma LOX IMVI | 0.0 |
| Trachea | 1.4 | Melanoma* (met) SK-MEL-5 | 0.0 |
| Kidney | 0.0 | Adipose | 0.0 |

TABLE CC

Panel 2D

| Tissue Name | Rel. Exp. (%) Ag1855, Run 160203054 | Tissue Name | Rel. Exp. (%) Ag1855, Run 160203054 |
|---|---|---|---|
| Normal Colon | 0.0 | Kidney Margin 8120608 | 0.0 |
| CC Well to Mod Diff (ODO3866) | 0.0 | Kidney Cancer 8120613 | 0.0 |
| CC Margin (ODO3866) | 0.0 | Kidney Margin 8120614 | 0.0 |
| CC Gr.2 rectosigmoid (ODO3868) | 0.0 | Kidney Cancer 9010320 | 0.0 |
| CC Margin (ODO3868) | 0.0 | Kidney Margin 9010321 | 0.0 |
| CC Mod Diff (ODO3920) | 0.0 | Normal Uterus | 0.0 |
| CC Margin (ODO3920) | 0.0 | Uterine Cancer 064011 | 0.0 |
| CC Gr.2 ascend colon (ODO3921) | 0.0 | Normal Thyroid | 0.0 |
| CC Margin (ODO3921) | 0.0 | Thyroid Cancer | 0.0 |
| CC from Partial Hepatectomy (ODO4309) Mets | 0.0 | Thyroid Cancer A302152 | 0.0 |
| Liver Margin (ODO4309) | 0.0 | Thyroid Margin A302153 | 0.0 |
| Colon mets to lung (OD04451-01) | 0.0 | Normal Breast | 0.0 |
| Lung Margin (OD04451-02) | 0.0 | Breast Cancer | 0.0 |
| Normal Prostate 6546-1 | 0.4 | Breast Cancer (OD04590-01) | 0.0 |
| Prostate Cancer (OD04410) | 0.0 | Breast Cancer Mets (OD04590-03) | 0.0 |
| Prostate Margin (OD04410) | 2.5 | Breast Cancer Metastasis | 0.0 |
| Prostate Cancer (OD04720-01) | 13.9 | Breast Cancer | 0.0 |
| Prostate Margin (OD04720-02) | 19.3 | Breast Cancer | 0.0 |
| Normal Lung | 4.0 | Breast Cancer 9100266 | 1.6 |
| Lung Met to Muscle (ODO4286) | 0.0 | Breast Margin 9100265 | 11.0 |
| Muscle Margin (ODO4286) | 0.0 | Breast Cancer A209073 | 0.0 |
| Lung Malignant Cancer (OD03126) | 0.0 | Breast Margin A2090734 | 0.0 |
| Lung Margin (OD03126) | 0.0 | Normal Liver | 0.0 |
| Lung Cancer (OD04404) | 100.0 | Liver Cancer | 0.0 |
| Lung Margin (OD04404) | 0.0 | Liver Cancer 1025 | 0.0 |
| Lung Cancer (OD04565) | 10.4 | Liver Cancer 1026 | 0.0 |
| Lung Margin (OD04565) | 0.0 | Liver Cancer 6004-T | 0.0 |
| Lung Cancer (OD04237-01) | 0.0 | Liver Tissue 6004-N | 0.0 |
| Lung Margin (OD04237-02) | 0.0 | Liver Cancer 6005-T | 0.0 |

TABLE CC-continued

Panel 2D

| Tissue Name | Rel. Exp. (%) Ag1855, Run 160203054 | Tissue Name | Rel. Exp. (%) Ag1855, Run 160203054 |
| --- | --- | --- | --- |
| Ocular Mel Met to Liver (ODO4310) | 0.0 | Liver Tissue 6005-N | 0.0 |
| Liver Margin (ODO4310) | 0.0 | Normal Bladder | 0.0 |
| Melanoma Metastasis | 0.0 | Bladder Cancer | 0.0 |
| Lung Margin (OD04321) | 0.0 | Bladder Cancer | 43.8 |
| Normal Kidney | 0.0 | Bladder Cancer (OD04718-01) | 12.8 |
| Kidney Ca, Nuclear grade 2 (OD04338) | 0.0 | Bladder Normal Adjacent (OD04718-03) | 0.0 |
| Kidney Margin (OD04338) | 0.0 | Normal Ovary | 0.0 |
| Kidney Ca Nuclear grade 1/2 (OD04339) | 0.0 | Ovarian Cancer | 0.0 |
| Kidney Margin (OD04339) | 0.0 | Ovarian Cancer (OD04768-07) | 0.0 |
| Kidney Ca, Clear cell type (OD04340) | 0.0 | Ovary Margin (OD04768-08) | 0.0 |
| Kidney Margin (OD04340) | 0.0 | Normal Stomach | 0.0 |
| Kidney Ca, Nuclear grade 3 (OD04348) | 0.0 | Gastric Cancer 9060358 | 0.0 |
| Kidney Margin (OD04348) | 0.0 | Stomach Margin 9060359 | 0.0 |
| Kidney Cancer (OD04622-01) | 0.0 | Gastric Cancer 9060395 | 0.0 |
| Kidney Margin (OD04622-03) | 0.0 | Stomach Margin 9060394 | 0.0 |
| Kidney Cancer (OD04450-01) | 0.0 | Gastric Cancer 9060397 | 0.0 |
| Kidney Margin (OD04450-03) | 0.0 | Stomach Margin 9060396 | 0.0 |
| Kidney Cancer 8120607 | 0.0 | Gastric Cancer 064005 | 0.0 |

TABLE CD

Panel 4D

| Tissue Name | Rel. Exp. (%) Ag1855, Run 160203067 | Tissue Name | Rel. Exp. (%) Ag1855, Run 160203067 |
| --- | --- | --- | --- |
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 0.0 |
| Primary Th1 act | 0.0 | Lung Microvascular EC TNF alpha + IL-1beta | 0.0 |
| Primary Th2 act | 0.0 | Microvascular Dermal EC none | 0.0 |
| Primary Tr1 act | 0.0 | Microvasular Dermal EC TNF alpha + IL-1beta | 0.0 |
| Primary Th1 rest | 5.4 | Bronchial epithelium TNF alpha + IL1beta | 0.0 |
| Primary Th2 rest | 13.7 | Small airway epithelium none | 42.3 |
| Primary Tr1 rest | 13.5 | Small airway epithelium TNF alpha + IL-1beta | 100.0 |
| CD45RA CD4 lymphocyte act | 0.0 | Coronery artery SMC rest | 0.0 |
| CD45RO CD4 lymphocyte act | 0.0 | Coronery artery SMC TNF alpha + IL-1beta | 0.0 |
| CD8 lymphocyte act | 0.0 | Astrocytes rest | 0.0 |
| Secondary CD8 lymphocyte rest | 0.0 | Astrocytes TNF alpha + IL-1beta | 0.0 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 36.3 |
| LAK cells rest | 0.0 | CCD1106 (Keratinocytes) TNF alpha + IL-1beta | 0.0 |
| LAK cells IL-2 | 0.0 | Liver cirrhosis | 0.0 |
| LAK cells IL-2 + IL-12 | 0.0 | Lupus kidney | 0.0 |

TABLE CD-continued

Panel 4D

| Tissue Name | Rel. Exp. (%) Ag1855, Run 160203067 | Tissue Name | Rel. Exp. (%) Ag1855, Run 160203067 |
|---|---|---|---|
| LAK cells IL-2 + IFN gamma | 0.0 | NCI-H292 none | 0.0 |
| LAK cells IL-2 + IL-18 | 0.0 | NCI-H292 IL-4 | 0.0 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 0.0 | Lung fibroblast none | 0.0 |
| PBMC PWM | 0.0 | Lung fibroblast TNF alpha + IL-1beta | 0.0 |
| PBMC PHA-L | 0.0 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 14.5 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1beta | 0.0 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 0.0 |
| Monocytes rest | 0.0 | IBD Crohn's | 0.0 |
| Monocytes LPS | 0.0 | Colon | 0.0 |
| Macrophages rest | 0.0 | Lung | 0.0 |
| Macrophages LPS | 0.0 | Thymus | 0.0 |
| HUVEC none | 0.0 | Kidney | 11.7 |
| HUVEC starved | 0.0 | | |

Panel 1.3D Summary: Ag1855 The highest level of expression is seen in SW620—a metastatic colon cancer cell line (CT=29.06). Hence, the expression of this gene may be used as a marker for colon cancer compared to normal colon tissue.

Panel 2D Summary: Ag1855 Expression of this gene is restricted to a few samples used in this panel. The highest level of expression is seen in lung cancer (CT=31.7). An enhanced level of expression is observed in lung and bladder cancer compared to normal adjacent tissue. Hence, the expression of this gene can be used as a marker of lung and bladder cancer.

Panel 4D Summary: Ag1855 This gene ecncodes a Type II cytokeratin-like protein and is moderately expressed in TNF-alpha and IL-1 beta-stimulated small airway epithelium (CT=33.9). This suggests that the gene product could potentially be a useful intracellular marker of activated cells in chronic obstructive pulmonary disease, and in asthma, allergy, and emphysema. Furthermore, this gene product may also be a useful small molecule target for the reduction or elimination of the symptoms caused by inflammation in lung epithelia in chronic obstructive pulmonary disease, and in asthma, allergy, and emphysema.

D. NOV6

GSAC023158_15A: SynaptotagminX-Like

Expression of gene GSAC023158_15_A was assessed using the primer-probe set Ag1557, described in Table DA. Results of the RTQ-PCR runs are shown in Tables DB, DC, DD and DE.

TABLE DA

Probe Name Ag1557

| Primers | Sequences | Length | Start Position | SEQ ID NO |
|---|---|---|---|---|
| Forward | 5'-gcgtgcacagaaagactttaaa-3' | 22 | 934 | 184 |
| Probe | TET-5'-tgatgaaacttttcaatttcctgtagca-3'-TAMRA | 28 | 965 | 185 |
| Reverse | 5'-tgaaatgtagttttcggttgct-3' | 22 | 1005 | 186 |

TABLE DB

CNS_neurodegeneration_v1.0

| Tissue Name | Rel. Exp. (%) Ag1557, Run 207575639 | Tissue Name | Rel. Exp. (%) Ag1557, Run 207575639 |
|---|---|---|---|
| AD 1 Hippo | 6.9 | Control (Path) 3 Temporal Ctx | 1.6 |
| AD 2 Hippo | 1.6 | Control (Path) 4 Temporal Ctx | 38.2 |
| AD 3 Hippo | 1.6 | AD 1 Occipital Ctx | 6.4 |
| AD 4 Hippo | 0.8 | AD 2 Occipital Ctx (Missing) | 0.0 |
| AD 5 Hippo | 62.4 | AD 3 Occipital Ctx | 1.2 |
| AD 6 Hippo | 46.7 | AD 4 Occipital Ctx | 67.8 |
| Control 2 Hippo | 11.5 | AD 5 Occipital Ctx | 47.0 |
| Control 4 Hippo | 9.9 | AD 5 Occipital Ctx | 8.8 |
| Control (Path) 3 Hippo | 3.7 | Control 1 Occipital Ctx | 1.5 |
| AD 1 Temporal Ctx | 0.5 | Control 2 Occipital Ctx | 42.6 |
| AD 2 Temporal Ctx | 28.9 | Control 3 Occipital Ctx | 5.9 |
| AD 3 Temporal Ctx | 2.8 | Control 4 Occipital Ctx | 0.7 |
| AD 4 Temporal Ctx | 24.7 | Control (Path) 1 Occipital Ctx | 79.6 |
| AD 5 Inf Temporal Ctx | 100.0 | Control (Path) 2 Occipital Ctx | 5.6 |
| AD 5 Sup Temporal Ctx | 23.7 | Control (Path) 3 Occipital Ctx | 0.0 |
| AD 6 Inf Temporal Ctx | 22.7 | Control (Path) 4 Occipital Ctx | 8.2 |
| AD 6 Sup Temporal Ctx | 47.0 | Control 1 Parietal Ctx | 1.8 |
| Control 1 Temporal Ctx | 2.1 | Control 2 Parietal Ctx | 21.6 |
| Control 2 Temporal Ctx | 49.0 | Control 3 Parietal Ctx | 7.7 |
| Control 3 Temporal Ctx | 0.0 | Control (Path) 1 Parietal Ctx | 63.7 |
| Control 3 Temporal Ctx | 2.1 | Control (Path) 2 Parietal Ctx | 33.4 |
| Control (Path) 1 Temporal Ctx | 48.0 | Control (Path) 3 Parietal Ctx | 4.6 |
| Control (Path) 2 Temporal Ctx | 48.6 | Control (Path) 4 Parietal Ctx | 42.6 |

TABLE DC

Panel 1.3D

| Tissue Name | Rel. Exp. (%) Ag1557, Run 146380320 | Rel. Exp. (%) Ag1557, Run 149871705 | Tissue Name | Rel. Exp. (%) Ag1557, Run 146380320 | Rel. Exp. (%) Ag1557, Run 149871705 |
|---|---|---|---|---|---|
| Liver adenocarcinoma | 0.0 | 0.0 | Kidney (fetal) | 0.0 | 7.7 |
| Pancreas | 0.0 | 4.9 | Renal ca. 786-0 | 2.3 | 0.0 |
| Pancreatic ca. CAPAN 2 | 0.0 | 0.0 | Renal ca. A498 | 0.0 | 0.0 |
| Adrenal gland | 2.0 | 0.0 | Renal ca. RXF 393 | 0.0 | 0.0 |
| Thyroid | 0.0 | 0.0 | Renal ca. ACHN | 0.0 | 0.0 |
| Salivary gland | 0.0 | 0.0 | Renal ca. UO-31 | 0.0 | 0.0 |
| Pituitary gland | 68.3 | 60.7 | Renal ca. TK-10 | 0.0 | 0.0 |
| Brain (fetal) | 0.0 | 0.0 | Liver | 1.8 | 8.0 |
| Brain (whole) | 43.8 | 34.6 | Liver (fetal) | 0.0 | 0.0 |
| Brain (amygdala) | 8.9 | 13.8 | Liver ca. (hepatoblast) HepG2 | 0.0 | 0.0 |
| Brain (cerebellum) | 0.0 | 0.0 | Lung | 0.0 | 0.0 |
| Brain (hippocampus) | 35.6 | 70.7 | Lung (fetal) | 0.0 | 0.0 |
| Brain (substantia nigra) | 2.1 | 0.0 | Lung ca. (small cell) LX-1 | 0.0 | 0.0 |
| Brain (thalamus) | 6.8 | 18.9 | Lung ca. (small cell) NCI-H69 | 0.0 | 0.0 |
| Cerebral Cortex | 98.6 | 100.0 | Lung ca. (s.cell var.) SHP-77 | 0.0 | 0.0 |
| Spinal cord | 21.5 | 13.2 | Lung ca. (large cell)NCI-H460 | 0.0 | 0.0 |
| glio/astro U87-MG | 0.0 | 0.0 | Lung ca. (non-sm. cell) A549 | 0.0 | 0.0 |
| glio/astro U-118- | 0.0 | 0.0 | Lung ca. (non- | 0.0 | 0.0 |

TABLE DC-continued

Panel 1.3D

| Tissue Name | Rel. Exp. (%) Ag1557, Run 146380320 | Rel. Exp. (%) Ag1557, Run 149871705 | Tissue Name | Rel. Exp. (%) Ag1557, Run 146380320 | Rel. Exp. (%) Ag1557, Run 149871705 |
|---|---|---|---|---|---|
| MG | | | s.cell) NCI-H23 | | |
| astrocytoma SW1783 | 0.0 | 0.0 | Lung ca. (non-s.cell) HOP-62 | 0.0 | 0.0 |
| neuro*; met SK-N-AS | 0.0 | 0.0 | Lung ca. (non-s.cl) NCI-H522 | 1.9 | 5.9 |
| astrocytoma SF-539 | 0.0 | 0.0 | Lung ca. (squam.) SW 900 | 5.3 | 0.0 |
| astrocytoma SNB-75 | 10.3 | 12.4 | Lung ca. (squam.) NCI-H596 | 0.0 | 0.0 |
| glioma SNB-19 | 0.0 | 0.0 | Mammary gland | 0.0 | 0.0 |
| glioma U251 | 1.6 | 0.0 | Breast ca.* (pl.ef) MCF-7 | 100.0 | 62.0 |
| glioma SF-295 | 0.0 | 0.0 | Breast ca.* (pl.ef) MDA-MB-231 | 0.0 | 0.0 |
| Heart (Fetal) | 1.6 | 0.0 | Breast ca.* (pl.ef) T47D | 0.0 | 0.0 |
| Heart | 0.0 | 0.0 | Breast ca. BT-549 | 3.5 | 0.0 |
| Skeletal muscle (Fetal) | 0.0 | 0.0 | Breast ca. MDA-N | 0.0 | 0.0 |
| Skeletal muscle | 0.0 | 0.0 | Ovary | 0.0 | 9.7 |
| Bone marrow | 0.0 | 0.0 | Ovarian ca. OVCAR-3 | 41.5 | 23.7 |
| Thymus | 0.0 | 0.0 | Ovarian ca. OVCAR-4 | 0.0 | 0.0 |
| Spleen | 0.0 | 0.0 | Ovarian ca. OVCAR-5 | 0.0 | 0.0 |
| Lymph node | 0.0 | 0.0 | Ovarian ca. OVCAR-8 | 0.0 | 0.0 |
| Colorectal | 5.6 | 9.7 | Ovarian ca. IGROV-1 | 0.0 | 0.0 |
| Stomach | 15.5 | 12.9 | Ovarian ca. (ascites) SK-OV-3 | 0.0 | 0.0 |
| Small intestine | 22.2 | 50.3 | Uterus | 4.2 | 4.6 |
| Colon ca. SW480 | 0.0 | 0.0 | Placenta | 0.0 | 0.0 |
| Colon ca.* SW620 (SW480 met) | 0.0 | 0.0 | Prostate | 7.2 | 11.2 |
| Colon ca. HT29 | 0.0 | 0.0 | Prostate ca.* (bone met) PC-3 | 0.0 | 0.0 |
| Colon ca. HCT-116 | 0.0 | 0.0 | Testis | 13.3 | 11.1 |
| Colon ca. CaCo-2 | 3.7 | 2.4 | Melanoma Hs688(A).T | 0.0 | 0.0 |
| CC Well to Mod Diff (ODO3866) | 0.0 | 0.0 | Melanoma* (met) Hs688(B).T | 0.0 | 0.0 |
| Colon ca. HCC-2998 | 0.0 | 0.0 | Melanoma UACC-62 | 0.0 | 0.0 |
| Gastric ca. (liver met) NCI-N87 | 0.0 | 0.0 | Melanoma M14 | 0.0 | 0.0 |
| Bladder | 0.0 | 7.8 | Melanoma LOX IMVI | 0.0 | 0.0 |
| Trachea | 2.6 | 3.8 | Melanoma* (met) SK-MEL-5 | 0.0 | 0.0 |
| Kidney | 2.4 | 18.4 | Adipose | 0.0 | 0.0 |

TABLE DD

Panel 2D

| Tissue Name | Rel. Exp. (%) Ag1557, Run 148394031 | Rel. Exp. (%) Ag1557, Run 149871817 | Tissue Name | Rel. Exp. (%) Ag1557, Run 148394031 | Rel. Exp. (%) Ag1557, Run 149871817 |
|---|---|---|---|---|---|
| Normal Colon | 22.5 | 51.4 | Kidney Margin 8120608 | 1.8 | 3.0 |
| CC Well to Mod Diff (ODO3866) | 0.0 | 2.1 | Kidney Cancer 8120613 | 100.0 | 100.0 |
| CC Margin (ODO3866) | 9.0 | 17.6 | Kidney Margin 8120614 | 2.0 | 1.4 |
| CC Gr.2 rectosigmoid (ODO3868) | 0.0 | 0.0 | Kidney Cancer 9010320 | 3.0 | 5.0 |
| CC Margin (ODO3868) | 3.7 | 10.3 | Kidney Margin 9010321 | 2.3 | 1.5 |
| CC Mod Diff (ODO3920) | 0.0 | 0.0 | Normal Uterus | 0.0 | 0.0 |
| CC Margin (ODO3920) | 6.8 | 15.6 | Uterine Cancer 064011 | 0.0 | 0.0 |
| CC Gr.2 ascend colon (ODO3921) | 9.6 | 11.8 | Normal Thyroid | 0.0 | 0.0 |
| CC Margin (ODO3921) | 4.6 | 6.3 | Thyroid Cancer | 1.0 | 0.0 |
| CC from Partial Hepatectomy (ODO4309) Mets | 0.0 | 1.2 | Thyroid Cancer A302152 | 0.0 | 0.0 |
| Liver Margin (ODO4309) | 2.3 | 1.2 | Thyroid Margin A302153 | 0.0 | 0.0 |
| Colon mets to lung (OD04451-01) | 0.0 | 2.1 | Normal Breast | 2.1 | 0.0 |
| Lung Margin (OD04451-02) | 0.0 | 0.0 | Breast Cancer | 0.0 | 0.0 |
| Normal Prostate 6546-1 | 8.2 | 8.2 | Breast Cancer (OD04590-01) | 0.0 | 0.0 |
| Prostate Cancer (OD04410) | 2.3 | 5.8 | Breast Cancer Mets (OD04590-03) | 1.4 | 0.0 |
| Prostate Margin (OD04410) | 13.8 | 16.6 | Breast Cancer Metastasis | 1.9 | 2.1 |
| Prostate Cancer (OD04720-01) | 7.2 | 14.9 | Breast Cancer | 41.2 | 0.0 |
| Prostate Margin (OD04720-02) | 54.0 | 60.3 | Breast Cancer | 0.0 | 0.0 |
| Normal Lung | 4.3 | 0.0 | Breast Cancer 9100266 | 1.3 | 0.8 |
| Lung Met to Muscle (ODO4286) | 0.0 | 2.6 | Breast Margin 9100265 | 0.0 | 0.0 |
| Muscle Margin (ODO4286) | 0.0 | 0.0 | Breast Cancer A209073 | 8.0 | 8.3 |
| Lung Malignant Cancer (OD03126) | 0.0 | 0.0 | Breast Margin A2090734 | 1.6 | 1.3 |
| Lung Margin (OD03126) | 2.0 | 2.4 | Normal Liver | 8.5 | 15.0 |
| Lung Cancer (OD04404) | 0.0 | 0.0 | Liver Cancer | 1.5 | 2.3 |
| Lung Margin (OD04404) | 0.0 | 0.0 | Liver Cancer 1025 | 3.4 | 6.4 |
| Lung Cancer (OD04565) | 0.0 | 0.0 | Liver Cancer 1026 | 0.0 | 1.7 |
| Lung Margin (OD04565) | 0.0 | 0.0 | Liver Cancer 6004-T | 7.1 | 2.0 |
| Lung Cancer (OD04237-01) | 51.1 | 51.1 | Liver Tissue 6004-N | 0.0 | 0.0 |
| Lung Margin (OD04237-02) | 0.0 | 1.4 | Liver Cancer 6005-T | 0.0 | 2.0 |
| Ocular Mel Met to | 0.0 | 0.0 | Liver Tissue | 1.5 | 4.9 |

TABLE DD-continued

Panel 2D

| Tissue Name | Rel. Exp. (%) Ag1557, Run 148394031 | Rel. Exp. (%) Ag1557, Run 149871817 | Tissue Name | Rel. Exp. (%) Ag1557, Run 148394031 | Rel. Exp. (%) Ag1557, Run 149871817 |
|---|---|---|---|---|---|
| Liver (ODO4310) | | | 6005-N | | |
| Liver Margin (ODO4310) | 3.5 | 6.3 | Normal Bladder | 1.9 | 4.5 |
| Melanoma Metastasis | 0.0 | 0.0 | Bladder Cancer | 14.0 | 19.6 |
| Lung Margin (OD04321) | 0.0 | 2.7 | Bladder Cancer | 2.9 | 9.4 |
| Normal Kidney | 87.7 | 76.8 | Bladder Cancer (OD04718-01) | 50.7 | 74.2 |
| Kidney Ca, Nuclear grade 2 (OD04338) | 4.7 | 8.8 | Bladder Normal Adjacent (OD04718-03) | 0.0 | 0.0 |
| Kidney Margin (OD04338) | 18.9 | 19.2 | Normal Ovary | 1.5 | 2.6 |
| Kidney Ca Nuclear grade 1/2 (OD04339) | 14.7 | 14.6 | Ovarian Cancer | 1.2 | 0.0 |
| Kidney Margin (OD04339) | 14.5 | 13.3 | Ovarian Cancer (OD04768-07) | 0.0 | 0.0 |
| Kidney Ca, Clear cell type (OD04340) | 0.0 | 0.0 | Ovary Margin (OD04768-08) | 0.0 | 0.0 |
| Kidney Margin (OD04340) | 21.0 | 15.0 | Normal Stomach | 13.8 | 15.3 |
| Kidney Ca, Nuclear grade 3 (OD04348) | 0.0 | 0.0 | Gastric Cancer 9060358 | 1.6 | 0.0 |
| Kidney Margin (OD04348) | 13.1 | 22.4 | Stomach Margin 9060359 | 6.7 | 8.4 |
| Kidney Cancer (OD04622-01) | 0.0 | 0.0 | Gastric Cancer 9060395 | 1.4 | 1.2 |
| Kidney Margin (OD04622-03) | 3.0 | 9.4 | Stomach Margin 9060394 | 2.5 | 9.0 |
| Kidney Cancer (OD04450-01) | 0.0 | 0.0 | Gastric Cancer 9060397 | 0.0 | 0.0 |
| Kidney Margin (OD04450-03) | 20.4 | 31.4 | Stomach Margin 9060396 | 0.0 | 0.0 |
| Kidney Cancer 8120607 | 3.7 | 7.7 | Gastric Cancer 064005 | 2.1 | 8.0 |

TABLE DE

Panel 4D

| Tissue Name | Rel. Exp. (%) Ag1557, Run 149871968 | Tissue Name | Rel. Exp. (%) Ag1557, Run 149871968 |
|---|---|---|---|
| Secondary Th1 act | 0.0 | HUVEC IL-1beta | 0.0 |
| Secondary Th2 act | 0.0 | HUVEC IFN gamma | 0.0 |
| Secondary Tr1 act | 0.0 | HUVEC TNF alpha + IFN gamma | 0.0 |
| Secondary Th1 rest | 0.0 | HUVEC TNF alpha + IL4 | 0.0 |
| Secondary Th2 rest | 0.0 | HUVEC IL-11 | 0.0 |
| Secondary Tr1 rest | 0.0 | Lung Microvascular EC none | 3.6 |
| Primary Th1 act | 0.0 | Lung Microvascular EC TNF alpha + IL-1beta | 0.0 |

TABLE DE-continued

Panel 4D

| Tissue Name | Rel. Exp. (%) Ag1557, Run 149871968 | Tissue Name | Rel. Exp. (%) Ag1557, Run 149871968 |
|---|---|---|---|
| Primary Th2 act | 0.0 | Microvascular Dermal EC none | 2.7 |
| Primary Tr1 act | 0.0 | Microvasular Dermal EC TNF alpha + IL-1beta | 0.0 |
| Primary Th1 rest | 0.0 | Bronchial epithelium TNF alpha + IL1beta | 0.0 |
| Primary Th2 rest | 0.0 | Small airway epithelium none | 3.6 |
| Primary Tr1 rest | 0.0 | Small airway epithelium TNF alpha + IL-1beta | 0.0 |
| CD45RA CD4 lymphocyte act | 0.0 | Coronery artery SMC rest | 0.0 |
| CD45RO CD4 lymphocyte act | 0.0 | Coronery artery SMC TNF alpha + IL-1beta | 0.0 |
| CD8 lymphocyte act | 0.0 | Astrocytes rest | 0.0 |
| Secondary CD8 lymphocyte rest | 0.0 | Astrocytes TNF alpha + IL-1beta | 0.0 |
| Secondary CD8 lymphocyte act | 0.0 | KU-812 (Basophil) rest | 0.0 |
| CD4 lymphocyte none | 0.0 | KU-812 (Basophil) PMA/ionomycin | 0.0 |
| 2ry Th1/Th2/Tr1_anti-CD95 CH11 | 0.0 | CCD1106 (Keratinocytes) none | 0.0 |
| LAK cells rest | 0.0 | CCD1106 (Keratinocytes) TNF alpha + IL-1beta | 0.0 |
| LAK cells IL-2 | 1.8 | Liver cirrhosis | 5.2 |
| LAK cells IL-2 + IL-12 | 0.0 | Lupus kidney | 1.9 |
| LAK cells IL-2 + IFN gamma | 0.0 | NCI-H292 none | 1.6 |
| LAK cells IL-2 + IL-18 | 0.0 | NCI-H292 IL-4 | 1.6 |
| LAK cells PMA/ionomycin | 0.0 | NCI-H292 IL-9 | 0.0 |
| NK Cells IL-2 rest | 0.0 | NCI-H292 IL-13 | 0.0 |
| Two Way MLR 3 day | 0.0 | NCI-H292 IFN gamma | 0.0 |
| Two Way MLR 5 day | 0.0 | HPAEC none | 0.0 |
| Two Way MLR 7 day | 0.0 | HPAEC TNF alpha + IL-1 beta | 0.0 |
| PBMC rest | 0.0 | Lung fibroblast none | 0.0 |
| PBMC PWM | 0.0 | Lung fibroblast TNF alpha + IL-1beta | 0.0 |
| PBMC PHA-L | 0.0 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 0.0 | Lung fibroblast IFN gamma | 0.0 |
| B lymphocytes CD40L and IL-4 | 0.0 | Dermal fibroblast CCD1070 rest | 0.0 |
| EOL-1 dbcAMP | 0.0 | Dermal fibroblast CCD1070 TNF alpha | 0.0 |
| EOL-1 dbcAMP PMA/ionomycin | 0.0 | Dermal fibroblast CCD1070 IL-1beta | 0.0 |
| Dendritic cells none | 0.0 | Dermal fibroblast IFN gamma | 0.0 |
| Dendritic cells LPS | 0.0 | Dermal fibroblast IL-4 | 0.0 |
| Dendritic cells anti-CD40 | 0.0 | IBD Colitis 2 | 7.3 |
| Monocytes rest | 0.0 | IBD Crohn's | 4.0 |
| Monocytes LPS | 0.0 | Colon | 28.1 |
| Macrophages rest | 0.0 | Lung | 2.0 |
| Macrophages LPS | 0.0 | Thymus | 100.0 |
| HUVEC none | 0.0 | Kidney | 0.0 |
| HUVEC starved | 0.0 | | |

CNS_neurodegeneration_v1.0 Summary: Ag1557 This gene, a synaptotagmin homolog, does not show differential expression between Alzheimer's diseased and control brains; however this panel demonstrates the expression of this gene in at least the cortex and hippocampus. Synaptotagmins are presynaptic proteins involved in presynaptic vesicle docking and neurotransmitter release. Blockage of this protein may be of therapeutic use in disorders that are treated by decreasing neurotransmission (epilepsy and seizure disorders, bipolar disorder, and schizophrenia).

Panel 1.3D Summary: Ag1557 Two runs with the same probe and primer set produce results that are in excellent agreement, with highest expression in a breast cancer cell line and the cerebral cortex (CTs=33–34.6). Thus, expression of this gene could potentially be used as a marker for breast cancer. Furthermore, the expression profile in this panel confirms expression of this gene in the cerebral cortex. Please see CNS_neurodegeneration_v1.0 for discussion of potential utility of this gene in the central nervous system.

This gene is also expressed at moderate levels in the pituitary gland. The protein encoded by this gene is homologous to synaptotagmin and may be important in the pituitary secretory pathway. Therefore, this gene product could be useful in the treatment of disease in this tissue.

Panel 2D Summary: Ag1557 The expression of this gene shows good concordance between two runs with the same probe and primer set. There are very low levels of expression of this gene in the pairs of tumor and normal adjacent tissue on this panel. Increased expression of this gene is seen in single samples of kidney(CTs=33), lung and bladder cancers compared to the normal adjacent tissues suggesting that this gene could be used as a marker to distinguish cancer from normal adjacent tissue. Furthermore, therapeutic inhibition of this gene activity, through the use of small molecule drugs or antibodies, might be of utility in the treatment of lung, bladder and kidney cancers.

Panel 4D Summary: Ag1557 was expressed at a moderate level (CT=33.39) in thymus (Panel 4D). This gene encodes a synaptotagmin-like protein that may be involved in vesicle trafficking in neuronal or non-neuronal cells in the thymus and thus may serve as a useful small molecule target. Drugs that inhibit the function of this synaptotagmin-like protein may reduce or eliminate the symptoms of autoimmune or inflammatory diseases that depend on the T cells that develop in the thymus, including asthma, allergies, inflammatory bowel disease, lupus erythematosus, or rheumatoid arthritis.

E. NOV4

GSAC022510_A: Serine Threonine Protein Phosphatase

Expression of gene GSAC022510_A was assessed using the primer-probe set Ag1556, described in Table EA.

TABLE EA

Probe Name Ag1556

| Primers | Sequences | Length | Start Position | SEQ ID NO |
|---|---|---|---|---|
| Forward | 5'-actacccgcataacgaaaatg-3' | 21 | 481 | 187 |
| Probe | TET-5'-ccgtcccaaagaaatgtccttttgaa-3'-TAMRA | 26 | 513 | 188 |
| Reverse | 5'-atccgttctagggtggtaac-3' | 21 | 549 | 189 |

Panel 1.3D Summary: Ag1556 Expression is low/undetectable in all samples on this panel (CTs>35).

F. NOV3

GSAC068993_A: RAS-RELATED

Expression of gene GSAC068993_13_A was assessed using the primer-probe set Ag1859, described in Table FA.

Panel 1.3D Summary: Ag1859 Expression is low/undetectable for all samples in this panel (CTs>35).

Panel 2D Summary: Ag1859 Expression is low/undetectable for all samples in this panel (CTs>35).

Panel 3D Summary: Ag1859 Expression is low/undetectable for all samples in this panel (CTs>35).

Panel 4D Summary: Ag1859 Expression is low/undetectable for all samples in this panel (CTs>35).

G. NOV9

GSAC046130_A and CG56017-01: Potassium Channel Regulatory Subunit-Like

Expression of gene GSAC046130_A and variant CG56017-01 was assessed using the primer-probe set Ag1852, described in Table GA. Results of the RTQ-PCR runs are shown in Tables GB, GC, GD and GE.

TABLE FA

Probe Name Ag1859

| Primers | Sequences | Length | Start Position | SEQ ID NO |
|---|---|---|---|---|
| Forward | 5'-ggcagctctgactctacagttc-3' | 22 | 121 | 190 |
| Probe | TET-5'-tgaaccatctaaagaaggcacctatcgg-3'-TAMRA | 28 | 169 | 191 |
| Reverse | 5'-tcgccatccagtactactctct-3' | 22 | 198 | 192 |

TABLE GA

Probe Name Ag1852

| Primers | Sequences | Length | Start Position | SEQ ID NO |
|---|---|---|---|---|
| Forward | 5'-ttggcttattccatgtcctta-3' | 22 | 790 | 193 |
| Probe | TET-5'-tatgctttgcttctgacttggccct-3'-TAMRA | 26 | 822 | 194 |
| Reverse | 5'-aacagaaatcccagaaggatgt-3' | 22 | 848 | 195 |

TABLE GB

CNS_neurodegeneration_v1.0

| Tissue Name | Rel. Exp. (%) Ag1852, Run 207807689 | Tissue Name | Rel. Exp. (%) Ag1852, Run 207807689 |
|---|---|---|---|
| AD 1 Hippo | 13.2 | Control (Path) 3 Temporal Ctx | 1.3 |
| AD 2 Hippo | 33.0 | Control (Path) 4 Temporal Ctx | 26.8 |
| AD 3 Hippo | 4.0 | AD 1 Occipital Ctx | 17.0 |
| AD 4 Hippo | 5.1 | AD 2 Occipital Ctx (Missing) | 0.0 |
| AD 5 Hippo | 100.0 | AD 3 Occipital Ctx | 9.3 |
| AD 6 Hippo | 62.9 | AD 4 Occipital Ctx | 14.9 |
| Control 2 Hippo | 25.0 | AD 5 Occipital Ctx | 22.8 |
| Control 4 Hippo | 15.6 | AD 5 Occipital Ctx | 34.9 |
| Control (Path) 3 Hippo | 10.4 | Control 1 Occipital Ctx | 3.3 |
| AD 1 Temporal Ctx | 21.5 | Control 2 Occipital Ctx | 55.9 |
| AD 2 Temporal Ctx | 32.3 | Control 3 Occipital Ctx | 14.8 |
| AD 3 Temporal Ctx | 3.2 | Control 4 Occipital Ctx | 2.7 |
| AD 4 Temporal Ctx | 28.1 | Control (Path) 1 Occipital Ctx | 94.0 |
| AD 5 Inf Temporal Ctx | 76.3 | Control (Path) 2 Occipital Ctx | 18.8 |
| AD 5 Sup Temporal Ctx | 63.7 | Control (Path) 3 Occipital Ctx | 6.6 |
| AD 6 Inf Temporal Ctx | 87.7 | Control (Path) 4 Occipital Ctx | 15.5 |
| AD 6 Sup Temporal Ctx | 80.7 | Control 1 Parietal Ctx | 3.1 |
| Control 1 Temporal Ctx | 4.9 | Control 2 Parietal Ctx | 50.7 |
| Control 2 Temporal Ctx | 34.2 | Control 3 Parietal Ctx | 16.3 |
| Control 3 Temporal Ctx | 17.2 | Control (Path) 1 Parietal Ctx | 94.0 |
| Control 3 Temporal Ctx | 12.0 | Control (Path) 2 Parietal Ctx | 26.4 |
| Control (Path) 1 Temporal Ctx | 32.3 | Control (Path) 3 Parietal Ctx | 7.2 |
| Control (Path) 2 Temporal Ctx | 40.3 | Control (Path) 4 Parietal Ctx | 38.2 |

TABLE GC

Panel 1.3D

| Tissue Name | Rel. Exp. (%) Ag1852, Run 152485809 | Tissue Name | Rel. Exp. (%) Ag1852, Run 152485809 |
|---|---|---|---|
| Liver adenocarcinoma | 42.6 | Kidney (fetal) | 8.8 |
| Pancreas | 3.3 | Renal ca. 786-0 | 21.3 |
| Pancreatic ca. CAPAN 2 | 14.2 | Renal ca. A498 | 14.2 |
| Adrenal gland | 6.2 | Renal ca. RXF 393 | 6.8 |
| Thyroid | 8.3 | Renal ca. ACHN | 10.3 |
| Salivary gland | 2.2 | Renal ca. UO-31 | 29.9 |
| Pituitary gland | 8.0 | Renal ca. TK-10 | 14.2 |
| Brain (fetal) | 7.7 | Liver | 1.4 |
| Brain (whole) | 10.4 | Liver (fetal) | 9.5 |
| Brain (amygdala) | 6.4 | Liver ca. (hepatoblast) HepG2 | 16.4 |
| Brain (cerebellum) | 7.2 | Lung | 6.7 |
| Brain (hippocampus) | 19.6 | Lung (fetal) | 9.9 |
| Brain (substantia nigra) | 3.4 | Lung ca. (small cell) LX-1 | 23.7 |
| Brain (thalamus) | 5.9 | Lung ca. (small cell) NCI-H69 | 3.8 |
| Cerebral Cortex | 19.8 | Lung ca. (s.cell var.) SHP-77 | 11.7 |
| Spinal cord | 5.6 | Lung ca. (large cell)NCI-H460 | 6.7 |
| glio/astro U87-MG | 8.3 | Lung ca. (non-sm. cell) A549 | 5.6 |
| glio/astro U-118-MG | 100.0 | Lung ca. (non-s.cell) NCI-H23 | 86.5 |
| astrocytoma SW1783 | 17.0 | Lung ca. (non-s.cell) HOP-62 | 23.8 |
| neuro*; met SK-N-AS | 27.9 | Lung ca. (non-s.cl) NCI-H522 | 25.9 |
| astrocytoma SF-539 | 32.3 | Lung ca. (squam.) SW 900 | 14.5 |
| astrocytoma SNB-75 | 30.8 | Lung ca. (squam.) NCI-H596 | 0.0 |
| glioma SNB-19 | 16.0 | Mammary gland | 9.4 |

TABLE GC-continued

Panel 1.3D

| Tissue Name | Rel. Exp. (%) Ag1852, Run 152485809 | Tissue Name | Rel. Exp. (%) Ag1852, Run 152485809 |
| --- | --- | --- | --- |
| glioma U251 | 12.6 | Breast ca.* (pl.ef) MCF-7 | 23.2 |
| glioma SF-295 | 16.5 | Breast ca.* (pl.ef) MDA-MB-231 | 19.9 |
| Heart (Fetal) | 4.0 | Breast ca.* (pl.ef) T47D | 34.4 |
| Heart | 3.4 | Breast ca. BT-549 | 14.3 |
| Skeletal muscle (Fetal) | 40.9 | Breast ca. MDA-N | 18.7 |
| Skeletal muscle | 1.6 | Ovary | 12.3 |
| Bone marrow | 11.5 | Ovarian ca. OVCAR-3 | 21.6 |
| Thymus | 15.1 | Ovarian ca. OVCAR-4 | 0.5 |
| Spleen | 17.8 | Ovarian ca. OVCAR-5 | 11.3 |
| Lymph node | 16.4 | Ovarian ca. OVCAR-8 | 15.2 |
| Colorectal | 7.3 | Ovarian ca. IGROV-1 | 7.1 |
| Stomach | 17.3 | Ovarian ca.* (ascites) SK-OV-3 | 21.3 |
| Small intestine | 12.9 | Uterus | 7.1 |
| Colon ca. SW480 | 52.1 | Placenta | 13.1 |
| Colon ca.* SW620 (SW480 met) | 30.1 | Prostate | 7.9 |
| Colon ca. HT29 | 9.9 | Prostate ca.* (bone met) PC-3 | 9.8 |
| Colon ca. HCT-116 | 21.2 | Testis | 30.6 |
| Colon ca. CaCo-2 | 24.3 | Melanoma Hs688(A).T | 10.2 |
| CC Well to Mod Diff (ODO3866) | 18.4 | Melanoma* (met) Hs688(B).T | 9.2 |
| Colon ca. HCC-2998 | 28.1 | Melanoma UACC-62 | 2.5 |
| Gastric ca.* (liver met) NCI-N87 | 32.1 | Melanoma M14 | 7.5 |
| Bladder | 5.1 | Melanoma LOX IMVI | 7.6 |
| Trachea | 8.5 | Melanoma* (met) SK-MEL-5 | 9.0 |
| Kidney | 3.1 | Adipose | 8.8 |

TABLE GD

Panel 2D

| Tissue Name | Rel. Exp. (%) Ag1852, Run 152784428 | Tissue Name | Rel. Exp. (%) Ag1852, Run 152784428 |
| --- | --- | --- | --- |
| Normal Colon | 34.9 | Kidney Margin 8120608 | 3.1 |
| CC Well to Mod Diff (ODO3866) | 15.0 | Kidney Cancer 8120613 | 8.8 |
| CC Margin (ODO3866) | 6.5 | Kidney Margin 8120614 | 5.3 |
| CC Gr.2 rectosigmoid (ODO3868) | 8.6 | Kidney Cancer 9010320 | 13.1 |
| CC Margin (ODO3868) | 2.6 | Kidney Margin 9010321 | 10.1 |
| CC Mod Diff (ODO3920) | 33.0 | Normal Uterus | 6.5 |
| CC Margin (ODO3920) | 7.0 | Uterine Cancer 064011 | 26.6 |
| CC Gr.2 ascend colon (ODO3921) | 27.4 | Normal Thyroid | 11.4 |
| CC Margin (ODO3921) | 6.7 | Thyroid Cancer | 24.3 |
| CC from Partial Hepatectomy (ODO4309) Mets | 29.5 | Thyroid Cancer A302152 | 11.5 |
| Liver Margin (ODO4309) | 12.7 | Thyroid Margin A302153 | 22.8 |
| Colon mets to lung (OD04451-01) | 12.9 | Normal Breast | 16.5 |
| Lung Margin (OD04451-02) | 9.1 | Breast Cancer | 9.7 |
| Normal Prostate 6546-1 | 17.0 | Breast Cancer (OD04590-01) | 28.3 |
| Prostate Cancer (OD04410) | 39.8 | Breast Cancer Mets (OD04590-03) | 30.4 |
| Prostate Margin (OD04410) | 34.9 | Breast Cancer Metastasis | 43.5 |
| Prostate Cancer (OD04720-01) | 32.3 | Breast Cancer | 14.4 |
| Prostate Margin (OD04720-02) | 46.3 | Breast Cancer | 22.7 |
| Normal Lung | 48.0 | Breast Cancer 9100266 | 22.2 |
| Lung Met to Muscle (ODO4286) | 19.9 | Breast Margin 9100265 | 11.0 |
| Muscle Margin (ODO4286) | 6.3 | Breast Cancer A209073 | 42.3 |
| Lung Malignant Cancer (OD03126) | 23.3 | Breast Margin A2090734 | 17.6 |
| Lung Margin (OD03126) | 33.0 | Normal Liver | 11.0 |
| Lung Cancer (OD04404) | 32.5 | Liver Cancer | 4.9 |

TABLE GD-continued

Panel 2D

| Tissue Name | Rel. Exp. (%) Ag1852, Run 152784428 | Tissue Name | Rel. Exp. (%) Ag1852, Run 152784428 |
|---|---|---|---|
| Lung Margin (OD04404) | 11.3 | Liver Cancer 1025 | 6.6 |
| Lung Cancer (OD04565) | 10.2 | Liver Cancer 1026 | 5.6 |
| Lung Margin (OD04565) | 6.7 | Liver Cancer 6004-T | 7.3 |
| Lung Cancer (OD04237-01) | 55.5 | Liver Tissue 6004-N | 11.0 |
| Lung Margin (OD04237-02) | 9.8 | Liver Cancer 6005-T | 3.7 |
| Ocular Mel Met to Liver (ODO4310) | 8.2 | Liver Tissue 6005-N | 3.4 |
| Liver Margin (ODO4310) | 12.3 | Normal Bladder | 36.9 |
| Melanoma Metastasis | 22.4 | Bladder Cancer | 5.3 |
| Lung Margin (OD04321) | 23.8 | Bladder Cancer | 14.9 |
| Normal Kidney | 42.9 | Bladder Cancer (OD04718-01) | 28.5 |
| Kidney Ca, Nuclear grade 2 (OD04338) | 43.5 | Bladder Normal Adjacent (OD04718-03) | 10.3 |
| Kidney Margin (OD04338) | 21.8 | Normal Ovary | 4.3 |
| Kidney Ca Nuclear grade 1/2 (OD04339) | 22.7 | Ovarian Cancer | 30.1 |
| Kidney Margin (OD04339) | 26.4 | Ovarian Cancer (OD04768-07) | 100.0 |
| Kidney Ca, Clear cell type (OD04340) | 36.6 | Ovary Margin (OD04768-08) | 2.0 |
| Kidney Margin (OD04340) | 23.5 | Normal Stomach | 12.2 |
| Kidney Ca, Nuclear grade 3 (OD04348) | 15.2 | Gastric Cancer 9060358 | 3.9 |
| Kidney Margin (OD04348) | 15.4 | Stomach Margin 9060359 | 10.9 |
| Kidney Cancer (OD04622-01) | 12.7 | Gastric Cancer 9060395 | 15.8 |
| Kidney Margin (OD04622-03) | 6.7 | Stomach Margin 9060394 | 13.4 |
| Kidney Cancer (OD04450-01) | 36.6 | Gastric Cancer 9060397 | 15.0 |
| Kidney Margin (OD04450-03) | 17.0 | Stomach Margin 9060396 | 6.3 |
| Kidney Cancer 8120607 | 2.9 | Gastric Cancer 064005 | 27.0 |

TABLE GE

Panel 4D

| Tissue Name | Rel. Exp. (%) Ag1852, Run 152784429 | Tissue Name | Rel. Exp. (%) Ag1852, Run 152784429 |
|---|---|---|---|
| Secondary Th1 act | 42.6 | HUVEC IL-1beta | 8.7 |
| Secondary Th2 act | 49.0 | HUVEC IFN gamma | 13.2 |
| Secondary Tr1 act | 51.8 | HUVEC TNF alpha + IFN gamma | 7.3 |
| Secondary Th1 rest | 10.7 | HUVEC TNF alpha + IL4 | 12.9 |
| Secondary Th2 rest | 13.4 | HUVEC IL-11 | 5.9 |
| Secondary Tr1 rest | 12.9 | Lung Microvascular EC none | 10.7 |
| Primary Th1 act | 42.3 | Lung Microvascular EC TNF alpha + IL-1beta | 9.9 |
| Primary Th2 act | 38.2 | Microvascular Dermal EC none | 17.1 |
| Primary Tr1 act | 53.2 | Microvasular Dermal EC TNF alpha + IL-1beta | 8.2 |
| Primary Th1 rest | 60.3 | Bronchial epithelium TNF alpha + IL1beta | 0.8 |
| Primary Th2 rest | 28.9 | Small airway epithelium none | 3.4 |
| Primary Tr1 rest | 23.5 | Small airway epithelium TNF alpha + IL-1beta | 28.3 |
| CD45RA CD4 lymphocyte act | 27.0 | Coronery artery SMC rest | 7.0 |
| CD45RO CD4 lymphocyte act | 47.3 | Coronery artery SMC TNF alpha + IL-1beta | 6.7 |
| CD8 lymphocyte act | 31.2 | Astrocytes rest | 5.9 |
| Secondary CD8 lymphocyte rest | 24.7 | Astrocytes TNF alpha + IL-1beta | 2.7 |
| Secondary CD8 lymphocyte act | 23.8 | KU-812 (Basophil) rest | 12.8 |
| CD4 lymphocyte none | 7.7 | KU-812 (Basophil) PMA/ionomycin | 27.5 |
| 2ry Th1/Th2/Tr1_anti-CD95 CH11 | 16.8 | CCD1106 (Keratinocytes) none | 20.4 |

TABLE GE-continued

Panel 4D

| Tissue Name | Rel. Exp. (%) Ag1852, Run 152784429 | Tissue Name | Rel. Exp. (%) Ag1852, Run 152784429 |
|---|---|---|---|
| LAK cells rest | 18.2 | CCD1106 (Keratinocytes) TNF alpha + IL-1beta | 2.3 |
| LAK cells IL-2 | 37.4 | Liver cirrhosis | 1.3 |
| LAK cells IL-2 + IL-12 | 27.4 | Lupus kidney | 0.4 |
| LAK cells IL-2 + IFN gamma | 42.9 | NCI-H292 none | 24.5 |
| LAK cells IL-2 + IL-18 | 41.2 | NCI-H292 IL-4 | 34.2 |
| LAK cells PMA/ionomycin | 5.8 | NCI-H292 IL-9 | 42.0 |
| NK Cells IL-2 rest | 24.3 | NCI-H292 IL-13 | 21.0 |
| Two Way MLR 3 day | 26.8 | NCI-H292 IFN gamma | 26.1 |
| Two Way MLR 5 day | 13.9 | HPAEC none | 10.8 |
| Two Way MLR 7 day | 15.2 | HPAEC TNF alpha + IL-1 beta | 8.0 |
| PBMC rest | 3.4 | Lung fibroblast none | 3.1 |
| PBMC PWM | 56.3 | Lung fibroblast TNF alpha + IL-1beta | 3.4 |
| PBMC PHA-L | 24.5 | Lung fibroblast IL-4 | 9.8 |
| Ramos (B cell) none | 48.3 | Lung fibroblast IL-9 | 7.1 |
| Ramos (B cell) ionomycin | 94.0 | Lung fibroblast IL-13 | 5.8 |
| B lymphocytes PWM | 100.0 | Lung fibroblast IFN gamma | 6.1 |
| B lymphocytes CD40L and IL-4 | 46.7 | Dermal fibroblast CCD1070 rest | 30.1 |
| EOL-1 dbcAMP | 17.7 | Dermal fibroblast CCD1070 TNF alpha | 61.1 |
| EOL-1 dbcAMP PMA/ionomycin | 12.3 | Dermal fibroblast CCD1070 IL-1beta | 18.0 |
| Dendritic cells none | 11.4 | Dermal fibroblast IFN gamma | 6.9 |
| Dendritic cells LPS | 11.7 | Dermal fibroblast IL-4 | 11.2 |
| Dendritic cells anti-CD40 | 8.7 | IBD Colitis 2 | 1.4 |
| Monocytes rest | 6.4 | IBD Crohn's | 0.9 |
| Monocytes LPS | 3.3 | Colon | 10.5 |
| Macrophages rest | 17.3 | Lung | 12.7 |
| Macrophages LPS | 7.0 | Thymus | 19.3 |
| HUVEC none | 17.7 | Kidney | 38.7 |
| HUVEC starved | 33.0 | | |

$CNS_{13}$ neurodegeneration_v1.0 Summary: Ag1852 No differential expression in this gene is detected between controls and Alzheimer's disease postmortem brains on this panel. This panel does confirm the expression of this gene in the brains of an independent sample of patients. Please see panel 1.3d for a discussion of utility in the central nervous system.

Panel 1.3D Summary: Ag1852 This gene is widely expressed at low to moderate levels in most samples in this panel, with highest expression in a brain cancer (CT=28.8). The level of expression appears to be slightly higher in pancreatic, colon, brain, kidney, lung, breast and ovarian cell lines; hence it may play an important role in cancers of these tissues. Therefore, inhibition of the gene product by antibodies, small molecule drugs and chimeric molecules may be effective in the treatment of these cancers.

This gene is moderately expressed in a variety of metabolic tissues including pancreas, adrenal, thyroid, pituitary, adult and fetal heart, liver and adipose. This gene product may be a small molecule drug target for the treatment of metabolic disease, including obesity and Types 1 and 2 diabetes.

In addition, this gene appears to be differentially expressed in fetal (CT=30) versus adult skeletal muscle (CT=35) and may be used to differentiate between the adult and fetal sources of this tissue. Furthermore, the relative overexpression of the gene in fetal skeletal muscle suggests that the protein product may enhance muscular growth or development in the fetus and thus may also act in a regenerative capacity in the adult. Therefore, therapeutic modulation of this gene could be useful in treatment of muscle related diseases. More specifically, treatment of weak or dystrophic muscle with the protein encoded by this gene could restore muscle mass or function.

This gene product has homology to a potassium channel regulatory subunit and is expressed at low to moderate level in all CNS regions examined. The majority of genes linked to seizure disorders are mutations in ion channels; furthermore almost all antiepileptics have ion channels as a primary site of action. The novel antiepileptic retigabine appears to work specifically by activating potassium channels. Therefore, this gene represents an excellent drug target for seizure disorders, as activation will most likely have an antiepileptic effect.

It has recently been discovered that a mutation in a gene that codes for a subunit of a ligand-gated channel results in a genetically transmissible form of epilepsy. This gene, CHRNA4, codes for a neuronal nicotinic acetylcholine receptor subunit, and functional studies were designed to evaluate the alterations caused by this mutation. Since this initial observation, five mutations have been identified and determination of their functional properties has been initiated. These experiments were extended to pairwise expression of the control and mutated allele to mimic the heterozygote human genotype. The first common functional trait identified so far, in four of these mutants, is an increased sensitivity to acetylcholine, suggesting that these mutations may cause a gain of function. An alternative possibility is that conditions in the brain are such that these higher responding receptors may be more prone to desensitization.

The importance of ionic channels as a cause of epilepsies was further demonstrated with the identification of the association between the benign neonatal epilepsy and mutations in genes coding for potassium channel subunits (KCNQ2, KCNQ3). Additional evidence was brought by the identification of mutations in voltage-dependent sodium channels (SCN1A, SCN1B) in a form of generalized epilepsy with febrile seizures. See Moulard, B. et al., *Brain Res. Rev.*, 2001 October; 36(2–3):275–84.

Retigabine [D-23129; N-(2-amino-4-(4-fluorobenzylamino)-phenyl) carbamic acid ethyl ester] is a novel anticonvulsant compound that is now in clinical phase II development. It has previously been shown to enhance currents generated by KCNQ2/3 K(+) channels when expressed in Chinese hamster ovary (CHO) cells. See Tatulian, L., *J Neurosci*, Aug. 1; 2001; 21(15):5535–45. This disclosure compares the actions of retigabine on KCNQ2/3 currents with those on currents generated by other members of the KCNQ family (homomeric KCNQ1, KCNQ2, KCNQ3, and KCNQ4 channels) expressed in CHO cells and on the native M current in rat sympathetic neurons thought to be generated by KCNQ2/3 channels. Retigabine produced a hyperpolarizing shift of the activation curves for KCNQ2/3, KCNQ2, KCNQ3, and KCNQ4 currents with differential potencies in the following order: KCNQ3>KCNQ2/3>KCNQ2>KCNQ4, as measured either by the maximum hyperpolarizing shift in the activation curves or by the EC(50) values. In contrast, retigabine did not enhance cardiac KCNQ1 currents. Retigabine also produced a hyperpolarizing shift in the activation curve for native M channels in rat sympathetic neurons. The retigabine-induced current was inhibited by muscarinic receptor stimulation, with similar agonist potency but 25% reduced maximum effect. In unclamped neurons, retigabine produced a hyperpolarization and reduced the number of action potentials produced by depolarizing current injections, without change in action potential configuration.

Panel 2D Summary: Ag1852 This gene is expressed at a low to moderate level in almost all cancer and normal adjacent tissues used in this panel. The highest level of expression is seen in an ovarian cancer sample (CT=29.1). Enhanced expression of this gene is seen in uterine, ovary, thyroid, colon and some lung and kidney cancers when compared to the normal adjacent tissue. Thus, expression of this gene may be used as a diagnostic marker for cancer in these tissues. In addition, therapeutic inhibition of the gene product could be effective in the treatment of these cancers.

Panel 4D Summary: Ag1852 This gene encodes a potassium channel regulatory subunit-like protein and is expressed at moderate levels (CT=29–32) in a wide range of cell types of significance in the immune response in health and disease. Inhibition of the function of the the putative channel with a small molecule drug may block the functions of B cells, T cells, and monocytes, and lead to improvement of the symptoms of patients suffering from autoimmune and inflammatory diseases such as asthma, allergies, inflammatory bowel disease, lupus erythematosus, or rheumatoid arthritis.

H. NOV2

GSAC055740_B: Ion Transporter-Like

Expression of gene GSAC055740_B was assessed using the primer-probe set Ag1864, described in Table HA. Results of the RTQ-PCR runs are shown in Table HB.

TABLE HA

Probe Name Ag1864

| Primers | Sequences | Length | Start Position | SEQ ID NO |
|---|---|---|---|---|
| Forward | 5'-accattgtcccttccattaaag-3' | 22 | 926 | 196 |
| Probe | TET-5'-tccagtcttttcagtgtcttcatcttcctg-3'-TAMRA | 30 | 965 | 197 |
| Reverse | 5'-aagaaggcatcccaagtagaag-3' | 22 | 997 | 198 |

TABLE HB

Panel 4D

| Tissue Name | Rel. Exp. (%) Ag1864, Run 165870451 | Tissue Name | Rel. Exp. (%) Ag1864, Run 165870451 |
|---|---|---|---|
| Secondary Th1 act | 6.4 | HUVEC IL-1beta | 0.0 |
| Secondary Th2 act | 42.6 | HUVEC IFN gamma | 0.1 |
| Secondary Tr1 act | 29.9 | HUVEC TNF alpha + IFN gamma | 0.1 |
| Secondary Th1 rest | 17.1 | HUVEC TNF alpha + IL4 | 0.0 |
| Secondary Th2 rest | 20.6 | HUVEC IL-11 | 0.0 |
| Secondary Tr1 rest | 27.9 | Lung Microvascular EC none | 0.1 |
| Primary Th1 act | 7.3 | Lung Microvascular EC TNF alpha + IL-1beta | 0.1 |
| Primary Th2 act | 18.0 | Microvascular Dermal EC none | 0.1 |
| Primary Tr1 act | 21.5 | Microvasular Dermal EC TNF alpha + IL-1beta | 0.1 |
| Primary Th1 rest | 100.0 | Bronchial epithelium TNF alpha + IL1beta | 0.3 |
| Primary Th2 rest | 45.7 | Small airway epithelium none | 0.9 |
| Primary Tr1 rest | 30.6 | Small airway epithelium TNF alpha + IL-1beta | 1.6 |

TABLE IIB-continued

Panel 4D

| Tissue Name | Rel. Exp. (%) Ag1864, Run 165870451 | Tissue Name | Rel. Exp. (%) Ag1864, Run 165870451 |
|---|---|---|---|
| CD45RA CD4 lymphocyte act | 15.1 | Coronery artery SMC rest | 0.0 |
| CD45RO CD4 lymphocyte act | 25.0 | Coronery artery SMC TNF alpha + IL-1beta | 0.0 |
| CD8 lymphocyte act | 28.7 | Astrocytes rest | 0.0 |
| Secondary CD8 lymphocyte rest | 23.3 | Astrocytes TNF alpha + IL-1beta | 0.0 |
| Secondary CD8 lymphocyte act | 14.7 | KU-812 (Basophil) rest | 0.0 |
| CD4 lymphocyte none | 34.9 | KU-812 (Basophil) PMA/ionomycin | 0.1 |
| 2ry Th1/Th2/Tr1_anti-CD95 CH11 | 27.2 | CCD1106 (Keratinocytes) none | 0.8 |
| LAK cells rest | 0.2 | CCD1106 (Keratinocytes) TNF alpha + IL-1beta | 7.7 |
| LAK cells IL-2 | 69.7 | Liver cirrhosis | 2.6 |
| LAK cells IL-2 + IL-12 | 47.3 | Lupus kidney | 2.9 |
| LAK cells IL-2 + IFN gamma | 73.7 | NCI-H292 none | 17.8 |
| LAK cells IL-2 + IL-18 | 46.7 | NCI-H292 IL-4 | 46.0 |
| LAK cells PMA/ionomycin | 5.1 | NCI-H292 IL-9 | 14.2 |
| NK Cells IL-2 rest | 46.7 | NCI-H292 IL-13 | 22.1 |
| Two Way MLR 3 day | 54.3 | NCI-H292 IFN gamma | 14.7 |
| Two Way MLR 5 day | 16.2 | HPAEC none | 0.1 |
| Two Way MLR 7 day | 10.5 | HPAEC TNF alpha + IL-1beta | 0.2 |
| PBMC rest | 16.0 | Lung fibroblast none | 0.0 |
| PBMC PWM | 15.9 | Lung fibroblast TNF alpha + IL-1beta | 0.0 |
| PBMC PHA-L | 5.4 | Lung fibroblast IL-4 | 0.0 |
| Ramos (B cell) none | 0.0 | Lung fibroblast IL-9 | 0.0 |
| Ramos (B cell) ionomycin | 0.0 | Lung fibroblast IL-13 | 0.0 |
| B lymphocytes PWM | 19.1 | Lung fibroblast IFN gamma | 0.0 |
| B lymphocytes CD40L and IL-4 | 20.2 | Dermal fibroblast CCD1070 rest | 0.0 |
| EOL-1 dbcAMP | 0.0 | Dermal fibroblast CCD1070 TNF alpha | 29.3 |
| EOL-1 dbcAMP PMA/ionomycin | 0.0 | Dermal fibroblast CCD1070 IL-1beta | 0.0 |
| Dendritic cells none | 2.8 | Dermal fibroblast IFN gamma | 0.0 |
| Dendritic cells LPS | 0.7 | Dermal fibroblast IL-4 | 0.0 |
| Dendritic cells anti-CD40 | 0.2 | IBD Colitis 2 | 7.6 |
| Monocytes rest | 1.2 | IBD Crohn's | 2.0 |
| Monocytes LPS | 1.4 | Colon | 47.0 |
| Macrophages rest | 6.3 | Lung | 2.8 |
| Macrophages LPS | 0.8 | Thymus | 2.7 |
| HUVEC none | 0.0 | Kidney | 33.2 |
| HUVEC starved | 0.0 | | |

Panel 4D Summary: This gene encodes an ion channel-like protein and is expressed (CTs=28–31) at a moderate level in resting and activated T cells, B cells, lymphokine-activated killer cells, and IL-4, IL-9, or IL-13-activated NCI-H292 mucoepidermoid cells. Small molecule antagonists that block the function of this gene product may be useful therapeutics for the reduction or elimination of the symptoms caused by inflammation in lung epithelia in chronic obstructive pulmonary disease, and in asthma, allergy, and emphysema.

I. NOV1

GSAC055740_A: PROCESSING ALPHA-1_2-MANNOSIDASE

Expression of gene GSAC055740_A was assessed using the primer-probe set Ag1861, described in Table IA. Results of the RTQ-PCR runs are shown in Tables IB, IC and ID.

TABLE IA

Probe Name Ag1861

| Primers | Sequences | Length | Start Position | SEQ ID NO |
|---|---|---|---|---|
| Forward | 5'-ggttatgcacattcggaaacta-3' | 22 | 730 | 199 |
| Probe | TET-5'-tggatcgtccaaatggtctttatcca-3'-TAMRA | 26 | 762 | 200 |
| Reverse | 5'-cctgttctggggttcaaataat-3' | 22 | 789 | 201 |

TABLE IB

Panel 1.3D

| Tissue Name | Rel. Exp. (%) Ag1861, Run 165974830 | Tissue Name | Rel. Exp. (%) Ag1861, Run 165974830 |
|---|---|---|---|
| Liver adenocarcinoma | 5.6 | Kidney (fetal) | 2.3 |
| Pancreas | 5.8 | Renal ca. 786-0 | 9.2 |
| Pancreatic ca. CAPAN 2 | 10.3 | Renal ca. A498 | 7.7 |
| Adrenal gland | 4.6 | Renal ca. RXF 393 | 6.6 |
| Thyroid | 2.7 | Renal ca. ACHN | 4.5 |
| Salivary gland | 7.2 | Renal ca. UO-31 | 7.6 |
| Pituitary gland | 6.6 | Renal ca. TK-10 | 5.8 |
| Brain (fetal) | 10.4 | Liver | 3.1 |
| Brain (whole) | 29.9 | Liver (fetal) | 2.1 |
| Brain (amygdala) | 12.8 | Liver ca. (hepatoblast) HepG2 | 9.5 |
| Brain (cerebellum) | 29.5 | Lung | 1.6 |
| Brain (hippocampus) | 14.4 | Lung (fetal) | 4.1 |
| Brain (substantia nigra) | 4.8 | Lung ca. (small cell) LX-1 | 9.9 |
| Brain (thalamus) | 15.4 | Lung ca. (small cell) NCI-H69 | 13.5 |
| Cerebral Cortex | 21.8 | Lung ca. (s.cell var.) SHP-77 | 7.9 |
| Spinal cord | 12.9 | Lung ca. (large cell)NCI-H460 | 3.7 |
| glio/astro U87-MG | 17.1 | Lung ca. (non-sm. cell) A549 | 2.7 |
| glio/astro U-118-MG | 11.7 | Lung ca. (non-s.cell) NCI-H23 | 7.4 |
| astrocytoma SW1783 | 11.7 | Lung ca. (non-s.cell) HOP-62 | 8.9 |
| neuro*; met SK-N-AS | 9.6 | Lung ca. (non-s.cl) NCI-H522 | 6.3 |
| astrocytoma SF-539 | 14.1 | Lung ca. (squam.) SW 900 | 7.9 |
| astrocytoma SNB-75 | 8.5 | Lung ca. (squam.) NCI-H596 | 14.1 |
| glioma SNB-19 | 47.3 | Mammary gland | 4.6 |
| glioma U251 | 17.0 | Breast ca.* (pl.ef) MCF-7 | 27.4 |
| glioma SF-295 | 10.4 | Breast ca.* (pl.ef) MDA-MB-231 | 4.5 |
| Heart (Fetal) | 1.8 | Breast ca.* (pl. ef) T47D | 6.5 |
| Heart | 3.4 | Breast ca. BT-549 | 4.4 |
| Skeletal muscle (Fetal) | 0.5 | Breast ca. MDA-N | 3.5 |
| Skeletal muscle | 6.3 | Ovary | 1.2 |
| Bone marrow | 3.3 | Ovarian ca. OVCAR-3 | 10.0 |
| Thymus | 3.7 | Ovarian ca. OVCAR-4 | 4.5 |
| Spleen | 2.9 | Ovarian ca. OVCAR-5 | 15.3 |
| Lymph node | 3.7 | Ovarian ca. OVCAR-8 | 12.9 |
| Colorectal | 3.8 | Ovarian ca. IGROV-1 | 8.5 |
| Stomach | 6.1 | Ovarian ca. (ascites) SK-OV-3 | 13.8 |
| Small intestine | 6.4 | Uterus | 6.1 |
| Colon ca. SW480 | 4.7 | Placenta | 100.0 |
| Colon ca.* SW620 (SW480 met) | 9.5 | Prostate | 2.3 |
| Colon ca. HT29 | 4.0 | Prostate ca.* (bone met) PC-3 | 13.8 |
| Colon ca. HCT-116 | 4.1 | Testis | 7.3 |
| Colon ca. CaCo-2 | 5.4 | Melanoma Hs688(A).T | 2.9 |
| CC Well to Mod Diff (ODO3866) | 5.6 | Melanoma* (met) Hs688(B).T | 3.0 |
| Colon ca. HCC-2998 | 6.3 | Melanoma UACC-62 | 8.1 |
| Gastric ca.* (liver met) NCI-N87 | 14.1 | Melanoma M14 | 3.6 |
| Bladder | 10.2 | Melanoma LOX IMVI | 0.7 |
| Trachea | 2.6 | Melanoma* (met) SK-MEL-5 | 5.6 |
| Kidney | 4.9 | Adipose | 7.6 |

TABLE IC

Panel 2.2

| Tissue Name | Rel. Exp. (%) Ag1861, Run 174148876 | Tissue Name | Rel. Exp. (%) Ag1861, Run 174148876 |
|---|---|---|---|
| Normal Colon | 39.0 | Kidney Margin (OD04348) | 80.7 |
| Colon cancer (OD06064) | 53.2 | Kidney malignant cancer (OD06204B) | 26.8 |
| Colon Margin (OD06064) | 47.6 | Kidney normal adjacent tissue (OD06204E) | 14.3 |
| Colon cancer (OD06159) | 6.5 | Kidney Cancer (OD04450-01) | 47.6 |
| Colon Margin (OD06159) | 20.3 | Kidney Margin (OD04450-03) | 32.3 |
| Colon cancer (OD06297-04) | 13.4 | Kidney Cancer 8120613 | 3.0 |
| Colon Margin (OD06297-015) | 54.3 | Kidney Margin 8120614 | 8.4 |
| CC Gr.2 ascend colon (ODO3921) | 12.0 | Kidney Cancer 9010320 | 3.4 |
| CC Margin (ODO3921) | 18.2 | Kidney Margin 9010321 | 2.8 |
| Colon cancer metastasis (OD06104) | 5.8 | Kidney Cancer 8120607 | 1.8 |
| Lung Margin (OD06104) | 23.7 | Kidney Margin 8120608 | 3.3 |
| Colon mets to lung (OD04451-01) | 25.0 | Normal Uterus | 100.0 |
| Lung Margin (OD04451-02) | 33.7 | Uterine Cancer 064011 | 28.7 |
| Normal Prostate | 13.1 | Normal Thyroid | 6.7 |
| Prostate Cancer (OD04410) | 14.0 | Thyroid Cancer | 21.5 |
| Prostate Margin (OD04410) | 12.1 | Thyroid Cancer A302152 | 36.3 |
| Normal Ovary | 6.7 | Thyroid Margin A302153 | 21.5 |
| Ovarian cancer (OD06283-03) | 23.8 | Normal Breast | 42.0 |
| Ovarian Margin (OD06283-07) | 22.1 | Breast Cancer | 13.5 |
| Ovarian Cancer | 11.9 | Breast Cancer | 10.6 |
| Ovarian cancer (OD06145) | 5.4 | Breast Cancer (OD04590-01) | 6.8 |
| Ovarian Margin (OD06145) | 34.6 | Breast Cancer Mets (OD04590-03) | 33.7 |
| Ovarian cancer (OD06455-03) | 18.9 | Breast Cancer Metastasis | 37.1 |
| Ovarian Margin (OD06455-07) | 57.0 | Breast Cancer | 18.2 |
| Normal Lung | 20.3 | Breast Cancer 9100266 | 13.1 |
| Invasive poor diff. lung adeno (ODO4945-01) | 10.0 | Breast Margin 9100265 | 13.9 |
| Lung Margin (ODO4945-03) | 22.8 | Breast Cancer A209073 | 8.7 |
| Lung Malignant Cancer (OD03126) | 20.7 | Breast Margin A2090734 | 32.1 |
| Lung Margin (OD03126) | 12.5 | Breast cancer (OD06083) | 33.7 |
| Lung Cancer (OD05014A) | 16.0 | Breast cancer node metastasis (OD06083) | 28.9 |
| Lung Margin (OD05014B) | 40.9 | Normal Liver | 31.6 |
| Lung cancer (OD06081) | 19.5 | Liver Cancer 1026 | 0.9 |
| Lung Margin (OD06081) | 21.9 | Liver Cancer 1025 | 17.0 |
| Lung Cancer (OD04237-01) | 12.5 | Liver Cancer 6004-T | 10.7 |
| Lung Margin (OD04237-02) | 44.8 | Liver Tissue 6004-N | 2.6 |
| Ocular Mel Met to Liver (ODO4310) | 18.8 | Liver Cancer 6005-T | 13.5 |
| Liver Margin (ODO4310) | 25.3 | Liver Tissue 6005-N | 13.5 |
| Melanoma Metastasis | 13.8 | Liver Cancer | 16.6 |
| Lung Margin (OD04321) | 42.9 | Normal Bladder | 23.8 |
| Normal Kidney | 13.9 | Bladder Cancer | 1.0 |
| Kidney Ca, Nuclear grade 2 (OD04338) | 72.7 | Bladder Cancer | 16.2 |
| Kidney Margin (OD04338) | 17.4 | Normal Stomach | 74.7 |
| Kidney Ca Nuclear grade 1/2 (OD04339) | 25.2 | Gastric Cancer 9060397 | 3.3 |
| Kidney Margin (OD04339) | 24.7 | Stomach Margin 9060396 | 6.7 |
| Kidney Ca, Clear cell type (OD04340) | 20.7 | Gastric Cancer 9060395 | 11.6 |
| Kidney Margin (OD04340) | 44.4 | Stomach Margin 9060394 | 36.3 |
| Kidney Ca, Nuclear grade 3 (OD04348) | 10.8 | Gastric Cancer 064005 | 24.3 |

TABLE ID

Panel 4D

| Tissue Name | Rel. Exp. (%) Ag1861, Run 165835346 | Tissue Name | Rel. Exp. (%) Ag1861, Run 165835346 |
|---|---|---|---|
| Secondary Th1 act | 32.1 | HUVEC IL-1beta | 37.6 |
| Secondary Th2 act | 30.8 | HUVEC IFN gamma | 27.0 |
| Secondary Tr1 act | 43.8 | HUVEC TNF alpha + IFN gamma | 15.0 |
| Secondary Th1 rest | 24.1 | HUVEC TNF alpha + IL4 | 18.3 |
| Secondary Th2 rest | 18.0 | HUVEC IL-11 | 15.1 |
| Secondary Tr1 rest | 24.8 | Lung Microvascular EC none | 20.0 |
| Primary Th1 act | 16.6 | Lung Microvascular EC TNF alpha + IL-1beta | 12.2 |
| Primary Th2 act | 41.2 | Microvascular Dermal EC none | 24.1 |
| Primary Tr1 act | 52.9 | Microvasular Dermal EC TNF alpha + IL-1beta | 18.6 |
| Primary Th1 rest | 92.7 | Bronchial epithelium TNF alpha + IL1beta | 15.5 |
| Primary Th2 rest | 50.0 | Small airway epithelium none | 9.3 |
| Primary Tr1 rest | 24.8 | Small airway epithelium TNF alpha + IL-1beta | 66.0 |
| CD45RA CD4 lymphocyte act | 22.1 | Coronery artery SMC rest | 33.7 |
| CD45RO CD4 lymphocyte act | 37.6 | Coronery artery SMC TNF alpha + IL-1beta | 15.0 |
| CD8 lymphocyte act | 24.5 | Astrocytes rest | 34.4 |
| Secondary CD8 lymphocyte rest | 33.9 | Astrocytes TNF alpha + IL-1beta | 39.2 |
| Secondary CD8 lymphocyte act | 21.6 | KU-812 (Basophil) rest | 18.9 |
| CD4 lymphocyte none | 21.0 | KU-812 (Basophil) PMA/ionomycin | 53.6 |
| 2ry Th1/Th2/Tr1_anti-CD95 CH11 | 26.4 | CCD1106 (Keratinocytes) none | 18.2 |
| LAK cells rest | 14.8 | CCD1106 (Keratinocytes) TNF alpha + IL-1beta | 49.0 |
| LAK cells IL-2 | 51.4 | Liver cirrhosis | 15.5 |
| LAK cells IL-2 + IL-12 | 44.8 | Lupus kidney | 23.3 |
| LAK cells IL-2 + IFN gamma | 32.8 | NCI-H292 none | 48.6 |
| LAK cells IL-2 + IL-18 | 33.0 | NCI-H292 IL-4 | 58.2 |
| LAK cells PMA/ionomycin | 15.4 | NCI-H292 IL-9 | 52.5 |
| NK Cells IL-2 rest | 25.0 | NCI-H292 IL-13 | 32.1 |
| Two Way MLR 3 day | 25.5 | NCI-H292 IFN gamma | 20.2 |
| Two Way MLR 5 day | 21.2 | HPAEC none | 16.0 |
| Two Way MLR 7 day | 15.0 | HPAEC TNF alpha + IL-1beta | 24.0 |
| PBMC rest | 25.3 | Lung fibroblast none | 41.5 |
| PBMC PWM | 24.3 | Lung fibroblast TNF alpha + IL-1beta | 39.8 |
| PBMC PHA-L | 8.5 | Lung fibroblast IL-4 | 66.9 |
| Ramos (B cell) none | 41.8 | Lung fibroblast IL-9 | 55.9 |
| Ramos (B cell) ionomycin | 27.5 | Lung fibroblast IL-13 | 34.2 |
| B lymphocytes PWM | 23.5 | Lung fibroblast IFN gamma | 45.7 |
| B lymphocytes CD40L and IL-4 | 36.3 | Dermal fibroblast CCD1070 rest | 43.5 |
| EOL-1 dbcAMP | 12.9 | Dermal fibroblast CCD1070 TNF alpha | 64.6 |
| EOL-1 dbcAMP PMA/ionomycin | 28.9 | Dermal fibroblast CCD1070 IL-1beta | 21.3 |
| Dendritic cells none | 13.2 | Dermal fibroblast IFN gamma | 10.7 |
| Dendritic cells LPS | 7.7 | Dermal fibroblast IL-4 | 24.8 |
| Dendritic cells anti-CD40 | 13.5 | IBD Colitis 2 | 6.9 |
| Monocytes rest | 23.8 | IBD Crohn's | 9.4 |
| Monocytes LPS | 10.4 | Colon | 100.0 |
| Macrophages rest | 20.6 | Lung | 22.4 |
| Macrophages LPS | 6.2 | Thymus | 39.5 |
| HUVEC none | 33.2 | Kidney | 28.1 |
| HUVEC starved | 54.0 | | |

Panel 1.3D Summary: Ag1861 This gene is ubiquitously expressed across all the samples in this panel, with highest expression in the placenta (CT=28.3). Among tissues with metabolic function, this gene is moderately expressed in a pancreas, adrenal, thyroid, pituitary, adult and fetal heart, adult and fetal liver, and adipose. This widespread expression suggests that this gene product may be a small molecule drug target for the treatment of metabolic disease, including obesity and Types 1 and 2 diabetes.

In addition, this gene is differentially expressed in fetal (CT=36) versus adult skeletal muscle (CT=32), and thus could be used to differentiate between the adult and fetal sources of this tissue.

This gene is also expressed at a slightly increased level in cancer cell lines derived from prostate, ovary, lung, kidney, colon and pancreas. Hence, this gene may be used as a marker for these cancer cell lines. In addition, therapeutic modulation of the gene product may be of use in the treatment of these cancers.

This gene is homologous to alpha 1,2-mannosidase, and is expressed at moderate levels in all brain regions examined. Alpha 1,2-mannosidase is involved in degradation of misfolded proteins. Because protein misfolding, precipitation and aggregation are common characteristics in a number of neurodegenerative diseases, (Alzheimer's, Parkinson's, Huntington's, spinocerebellar ataxia, Crutzfelt-Jackob, and HSE) this gene is an excellent drug target. Manipulation of the levels or efficacy of this protein in the brain may decrease neurodegeneration in any or all of the diseases listed above.

Endoplasmic reticulum (ER) class I alpha1,2-mannosidase (also known as ER alpha-mannosidase I) is a critical enzyme in the maturation of N-linked oligosaccharides and ER-associated degradation. Trimming of a single mannose residue acts as a signal to target misfolded glycoproteins for degradation by the proteasome. Crystal structures of the catalytic domain of human ER class I alpha1, 2-mannosidase have been determined both in the presence and absence of the potent inhibitors kifunensine and 1-deoxymannojirimycin. Both inhibitors bind to the protein at the bottom of the active-site cavity, with the essential calcium ion coordinating the O-2' and O-3' hydroxyls and stabilizing the six-membered rings of both inhibitors in a (1)C(4) conformation. This is the first direct evidence of the role of the calcium ion. The lack of major conformational changes upon inhibitor binding and structural comparisons with the yeast alpha1,2-mannosidase enzyme-product complex suggest that this class of inverting enzymes has a novel catalytic mechanism. The structures also provide insight into the specificity of this class of enzymes and provide a blueprint for the future design of novel inhibitors that prevent degradation of misfolded proteins in genetic diseases. See Vallee, F., et al., *J Biol Chem* 2000 Dec. 29; 275(52):41287–98.

Panel 2.2 Summary: Ag1861 This gene is expressed at moderate level in the all tissues used in this panel, with highest expression in normal uterus (CT=30.2). This gene appears to be expressed at slightly increased levels in thyroid cancer when compared to normal adjacent tissues. Hence, this gene may be used as a marker for thyroid cancer. In addition, normal adjacent tissues from stomach, uterus and some lung, kidney, ovary and colon samples show a slightly higher expression when compared to the matching cancer tissue. Thus, the expression of this gene may also be used as a marker for these cancers. Furthermore, therapeutic modulation of the gene product may be of use in the treatment of thyroid, gastric, uterine, ovarian, lung, kidney and colon cancers, as modulation of this gene product may have an effect on post-translational processing of other gene products.

Panel 4D Summary: This gene encodes a protein that is homologous to alpha-1,2-mannosidase and is expressed at moderate to high levels (CT=25–30) in numerous cell types that are active in the immune response in health and disease, including T and B cells, monocytes, and dendritic cells. Therefore, antagonist small molecule drugs directed to the gene product may be useful as therapeutics to reduce or eliminate the symptoms of patients suffering from autoimmune and inflammatory diseases such as asthma, allergies, inflammatory bowel disease, lupus erythematosus, or rheumatoid arthritis.

J. NOV18

AC073079_C: Calcium Transporter-Like

Expression of gene AC073079_C was assessed using the primer-probe set Ag2072, described in Table JA. Results of the RTQ-PCR runs are shown in Table JB.

TABLE JA

Probe Name Ag2072

| Primers | Sequences | Length | Start Position | SEQ ID NO |
|---|---|---|---|---|
| Forward | 5'-catgttcagcattgtcaacttc-3' | 22 | 1662 | 202 |
| Probe | TET-5'-atcattgccacactgctcatgctca-3'-TAMRA | 25 | 1693 | 203 |
| Reverse | 5'-catcatggcgatgaacaagt-3' | 20 | 1718 | 204 |

TABLE JB

Panel 1.3D

| Tissue Name | Rel. Exp. (%) Ag2072, Run 165627441 | Tissue Name | Rel. Exp. (%) Ag2072, Run 165627441 |
|---|---|---|---|
| Liver adenocarcinoma | 0.0 | Kidney (fetal) | 2.4 |
| Pancreas | 0.0 | Renal ca. 786-0 | 0.0 |
| Pancreatic ca. CAPAN 2 | 0.0 | Renal ca. A498 | 0.0 |
| Adrenal gland | 0.0 | Renal ca. RXF 393 | 0.0 |
| Thyroid | 0.0 | Renal ca. ACHN | 0.0 |
| Salivary gland | 3.9 | Renal ca. UO-31 | 0.0 |
| Pituitary gland | 0.0 | Renal ca. TK-10 | 0.0 |

TABLE JB-continued

Panel 1.3D

| Tissue Name | Rel. Exp. (%) Ag2072, Run 165627441 | Tissue Name | Rel. Exp. (%) Ag2072, Run 165627441 |
|---|---|---|---|
| Brain (fetal) | 6.6 | Liver | 0.0 |
| Brain (whole) | 45.1 | Liver (fetal) | 3.6 |
| Brain (amygdala) | 22.7 | Liver ca. (hepatoblast) HepG2 | 0.0 |
| Brain (cerebellum) | 4.4 | Lung | 0.0 |
| Brain (hippocampus) | 42.9 | Lung (fetal) | 3.5 |
| Brain (substantia nigra) | 33.4 | Lung ca. (small cell) LX-1 | 0.0 |
| Brain (thalamus) | 100.0 | Lung ca. (small cell) NCI-H69 | 0.0 |
| Cerebral Cortex | 0.0 | Lung ca. (s.cell var.) SHP-77 | 0.0 |
| Spinal cord | 14.4 | Lung ca. (large cell)NCI-H460 | 0.0 |
| glio/astro U87-MG | 0.0 | Lung ca. (non-sm. cell) A549 | 0.0 |
| glio/astro U-118-MG | 0.0 | Lung ca. (non-s.cell) NCI-H23 | 0.0 |
| astrocytoma SW1783 | 0.0 | Lung ca. (non-s.cell) HOP-62 | 0.0 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.0 |
| astrocytoma SNB-75 | 0.0 | Lung ca. (squam.) NCI-H596 | 0.0 |
| glioma SNB-19 | 0.0 | Mammary gland | 4.3 |
| glioma U251 | 0.0 | Breast ca.* (pl.ef) MCF-7 | 0.0 |
| glioma SF-295 | 0.0 | Breast ca.* (pl.ef) MDA-MB-231 | 0.0 |
| Heart (Fetal) | 0.0 | Breast ca.* (pl. ef) T47D | 0.0 |
| Heart | 0.0 | Breast ca. BT-549 | 0.0 |
| Skeletal muscle (Fetal) | 0.0 | Breast ca. MDA-N | 0.0 |
| Skeletal muscle | 0.0 | Ovary | 0.0 |
| Bone marrow | 3.2 | Ovarian ca. OVCAR-3 | 0.0 |
| Thymus | 0.0 | Ovarian ca. OVCAR-4 | 0.0 |
| Spleen | 0.0 | Ovarian ca. OVCAR-5 | 0.0 |
| Lymph node | 0.0 | Ovarian ca. OVCAR-8 | 3.1 |
| Colorectal | 2.3 | Ovarian ca. IGROV-1 | 0.0 |
| Stomach | 0.0 | Ovarian ca. (ascites) SK-OV-3 | 0.0 |
| Small intestine | 0.0 | Uterus | 0.0 |
| Colon ca. SW480 | 0.0 | Placenta | 6.4 |
| Colon ca.* SW620 (SW480 met) | 0.0 | Prostate | 0.0 |
| Colon ca. HT29 | 6.8 | Prostate ca.* (bone met) PC-3 | 0.0 |
| Colon ca. HCT-116 | 0.0 | Testis | 9.5 |
| Colon ca. CaCo-2 | 0.0 | Melanoma Hs688(A).T | 0.0 |
| CC Well to Mod Diff (ODO3866) | 0.0 | Melanoma* (met) Hs688(B).T | 0.0 |
| Colon ca. HCC-2998 | 0.0 | Melanoma UACC-62 | 0.0 |
| Gastric ca. (liver met) NCI-N87 | 0.0 | Melanoma M14 | 0.0 |
| Bladder | 0.0 | Melanoma LOX IMVI | 0.0 |
| Trachea | 0.0 | Melanoma* (met) SK-MEL-5 | 0.0 |
| Kidney | 10.9 | Adipose | 0.0 |

Panel 1.3D Summary: Ag2072 This gene is homologous to a calcium transport protein and shows a tissue distribution that is highly brain-preferential. Inhibition of calcium uptake has been shown to decrease neuronal death in response to cerebral ischemia. Therefore, this gene represents an excellent drug target for the treatment of stroke. Treatment with an antagonist immediately after stroke could decrease total infarct volume and lessen the overall stroke severity.

Recently the effect of the compound 2-[4-[(2,5-difluorophenyl)methoxy]phenoxy]-5-ethoxyaniline (SEA0400) on the Na+-Ca2+ exchanger (NCX) was investigated and compared against that of 2-[2-[4-(4-nitrobenzyloxy)phenyl]ethyl]isothiourea (KB-R7943). In addition, the effects of SEA0400 on reperfusion injury in vitro and in vivo were examined. SEA0400 was extremely more potent than KB-R7943 in inhibiting Na+-dependent Ca2+ uptake in cultured neurons, astrocytes, and microglia: IC50s of SEA0400 and KB-R7943 were 5 to 33 nM and 2 to 4 microM, respectively. SEA0400 at the concentration range that inhibited NCX exhibited negligible affinities for the Ca2+ channels, Na+ channels, K+ channels, norepinephrine transporter, and 14 receptors, and did not affect the activities of the Na+/H+ exchanger, Na+,K+-ATPase, Ca2+-ATPase, and five enzymes. SEA0400, unlike KB-R7943, did not inhibit the store-operated Ca2+ entry in cultured astrocytes. SEA0400 attenuated dose-dependently paradoxical Ca2+ challenge-induced production of reactive oxygen species, DNA ladder formation, and nuclear condensation in cultured astrocytes, whereas it did not affect thapsigargin-induced cell injury. Furthermore, administration of SEA0400 reduced infarct volumes after a transient middle cerebral artery occlusion in rat cerebral cortex and striatum. These results indicate that SEA0400 is the most potent and selective inhibitor of NCX, and suggest that the compound may exert protective effects on postischemic brain damage.

See Matsuda, T., et al., *J Pharmacol Exp Ther,* 2001 July; 298(1):249–56.

K. NOV20 AC018946_4_A and CG56872-02: GABA Receptor Associated-Like

Expression of gene AC018946_4_A and variant CG56872-02 was assessed using the primer-probe set Ag1911, described in Table KA. Results of the RTQ-PCR runs are shown in Tables KB, KC and KD.

TABLE KA

Probe Name Ag1911

| Primers | Sequences | Length | Start Position | SEQ ID NO |
|---|---|---|---|---|
| Forward | 5'-ggacgccttattcttctttgtc-3' | 22 | 219 | 205 |
| Probe | TET-5'-atccctcccactagtgctaccatggg-3'-TAMRA | 26 | 250 | 206 |
| Reverse | 5'-tcttcctcatgactgtcctcat-3' | 22 | 284 | 207 |

TABLE KB

Panel 1.3D

| Tissue Name | Rel. Exp. (%) Ag1911, Run 147709550 | Tissue Name | Rel. Exp. (%) Ag1911, Run 147709550 |
|---|---|---|---|
| Liver adenocarcinoma | 29.7 | Kidney (fetal) | 7.3 |
| Pancreas | 2.1 | Renal ca. 786-0 | 3.4 |
| Pancreatic ca. CAPAN 2 | 0.2 | Renal ca. A498 | 2.6 |
| Adrenal gland | 0.0 | Renal ca. RXF 393 | 0.4 |
| Thyroid | 3.9 | Renal ca. ACHN | 3.4 |
| Salivary gland | 4.2 | Renal ca. UO-31 | 1.2 |
| Pituitary gland | 11.6 | Renal ca. TK-10 | 0.7 |
| Brain (fetal) | 4.1 | Liver | 3.3 |
| Brain (whole) | 21.6 | Liver (fetal) | 7.6 |
| Brain (amygdala) | 30.6 | Liver ca. (hepatoblast) HepG2 | 0.5 |
| Brain (cerebellum) | 6.0 | Lung | 11.0 |
| Brain (hippocampus) | 100.0 | Lung (fetal) | 3.5 |
| Brain (substantia nigra) | 6.3 | Lung ca. (small cell) LX-1 | 0.7 |
| Brain (thalamus) | 18.9 | Lung ca. (small cell) NCI-H69 | 0.1 |
| Cerebral Cortex | 98.6 | Lung ca. (s.cell var.) SHP-77 | 0.7 |
| Spinal cord | 4.2 | Lung ca. (large cell)NCI-H460 | 2.3 |
| glio/astro U87-MG | 1.8 | Lung ca. (non-sm. cell) A549 | 0.6 |
| glio/astro U-118-MG | 0.5 | Lung ca. (non-s.cell) NCI-H23 | 9.2 |
| astrocytoma SW1783 | 1.1 | Lung ca. (non-s.cell) HOP-62 | 3.4 |
| neuro*; met SK-N-AS | 0.1 | Lung ca. (non-s.cl) NCI-H522 | 0.8 |
| astrocytoma SF-539 | 0.8 | Lung ca. (squam.) SW 900 | 1.8 |
| astrocytoma SNB-75 | 5.0 | Lung ca. (squam.) NCI-H596 | 0.0 |
| glioma SNB-19 | 1.5 | Mammary gland | 4.3 |
| glioma U251 | 0.9 | Breast ca.* (pl.ef) MCF-7 | 0.1 |
| glioma SF-295 | 2.9 | Breast ca.* (pl.ef) MDA-MB-231 | 1.8 |
| Heart (Fetal) | 7.5 | Breast ca.* (pl. ef) T47D | 0.2 |
| Heart | 8.5 | Breast ca. BT-549 | 1.0 |
| Skeletal muscle (Fetal) | 14.7 | Breast ca. MDA-N | 1.0 |
| Skeletal muscle | 5.0 | Ovary | 0.0 |
| Bone marrow | 4.2 | Ovarian ca. OVCAR-3 | 0.8 |
| Thymus | 1.4 | Ovarian ca. OVCAR-4 | 0.1 |
| Spleen | 1.9 | Ovarian ca. OVCAR-5 | 0.9 |
| Lymph node | 0.9 | Ovarian ca. OVCAR-8 | 2.0 |
| Colorectal | 1.0 | Ovarian ca. IGROV-1 | 0.3 |
| Stomach | 3.2 | Ovarian ca. (ascites) SK-OV-3 | 0.1 |
| Small intestine | 2.1 | Uterus | 0.0 |
| Colon ca. SW480 | 2.7 | Placenta | 40.9 |
| Colon ca.* SW620 (SW480 met) | 0.2 | Prostate | 2.6 |

TABLE KB-continued

Panel 1.3D

| Tissue Name | Rel. Exp. (%) Ag1911, Run 147709550 | Tissue Name | Rel. Exp. (%) Ag1911, Run 147709550 |
|---|---|---|---|
| Colon ca. HT29 | 0.3 | Prostate ca.* (bone met) PC-3 | 0.3 |
| Colon ca. HCT-116 | 0.6 | Testis | 4.3 |
| Colon ca. CaCo-2 | 2.8 | Melanoma Hs688(A).T | 9.7 |
| CC Well to Mod Diff (ODO3866) | 1.3 | Melanoma* (met) Hs688(B).T | 18.7 |
| Colon ca. HCC-2998 | 1.0 | Melanoma UACC-62 | 0.5 |
| Gastric ca. (liver met) NCI-N87 | 6.4 | Melanoma M14 | 0.5 |
| Bladder | 4.5 | Melanoma LOX IMVI | 75.8 |
| Trachea | 4.6 | Melanoma* (met) SK-MEL-5 | 0.7 |
| Kidney | 4.8 | Adipose | 10.3 |

TABLE KC

Panel 2D

| Tissue Name | Rel. Exp. (%) Ag1911, Run 155311696 | Tissue Name | Rel. Exp. (%) Ag1911, Run 155311696 |
|---|---|---|---|
| Normal Colon | 49.3 | Kidney Margin 8120608 | 44.1 |
| CC Well to Mod Diff (ODO3866) | 16.6 | Kidney Cancer 8120613 | 100.0 |
| CC Margin (ODO3866) | 17.0 | Kidney Margin 8120614 | 31.9 |
| CC Gr.2 rectosigmoid (ODO3868) | 6.2 | Kidney Cancer 9010320 | 12.4 |
| CC Margin (ODO3868) | 10.2 | Kidney Margin 9010321 | 38.7 |
| CC Mod Diff (ODO3920) | 8.0 | Normal Uterus | 7.5 |
| CC Margin (ODO3920) | 18.6 | Uterine Cancer 064011 | 14.5 |
| CC Gr.2 ascend colon (ODO3921) | 22.7 | Normal Thyroid | 20.6 |
| CC Margin (ODO3921) | 10.4 | Thyroid Cancer | 9.7 |
| CC from Partial Hepatectomy (ODO4309) Mets | 35.6 | Thyroid Cancer A302152 | 9.2 |
| Liver Margin (ODO4309) | 51.1 | Thyroid Margin A302153 | 18.3 |
| Colon mets to lung (OD04451-01) | 8.3 | Normal Breast | 15.0 |
| Lung Margin (OD04451-02) | 21.8 | Breast Cancer | 1.4 |
| Normal Prostate 6546-1 | 27.7 | Breast Cancer (OD04590-01) | 10.6 |
| Prostate Cancer (OD04410) | 34.4 | Breast Cancer Mets (OD04590-03) | 15.4 |
| Prostate Margin (OD04410) | 40.1 | Breast Cancer Metastasis | 16.5 |
| Prostate Cancer (OD04720-01) | 19.9 | Breast Cancer | 6.3 |
| Prostate Margin (OD04720-02) | 40.6 | Breast Cancer | 19.6 |
| Normal Lung | 64.2 | Breast Cancer 9100266 | 16.7 |
| Lung Met to Muscle (ODO4286) | 13.5 | Breast Margin 9100265 | 9.4 |
| Muscle Margin (ODO4286) | 22.7 | Breast Cancer A209073 | 9.3 |
| Lung Malignant Cancer (OD03126) | 38.7 | Breast Margin A2090734 | 10.1 |
| Lung Margin (OD03126) | 49.7 | Normal Liver | 19.6 |
| Lung Cancer (OD04404) | 21.8 | Liver Cancer | 11.8 |
| Lung Margin (OD04404) | 18.9 | Liver Cancer 1025 | 18.9 |
| Lung Cancer (OD04565) | 12.0 | Liver Cancer 1026 | 5.0 |
| Lung Margin (OD04565) | 11.4 | Liver Cancer 6004-T | 19.1 |
| Lung Cancer (OD04237-01) | 20.3 | Liver Tissue 6004-N | 11.7 |
| Lung Margin (OD04237-02) | 41.5 | Liver Cancer 6005-T | 5.3 |
| Ocular Mel Met to Liver (ODO4310) | 23.0 | Liver Tissue 6005-N | 13.5 |
| Liver Margin (ODO4310) | 50.3 | Normal Bladder | 37.1 |
| Melanoma Metastasis | 11.1 | Bladder Cancer | 2.6 |
| Lung Margin (OD04321) | 46.3 | Bladder Cancer | 7.4 |
| Normal Kidney | 96.6 | Bladder Cancer (OD04718-01) | 25.3 |
| Kidney Ca, Nuclear grade 2 (OD04338) | 47.3 | Bladder Normal Adjacent (OD04718-03) | 24.1 |
| Kidney Margin (OD04338) | 66.0 | Normal Ovary | 11.3 |

TABLE KC-continued

Panel 2D

| Tissue Name | Rel. Exp. (%) Ag1911, Run 155311696 | Tissue Name | Rel. Exp. (%) Ag1911, Run 155311696 |
|---|---|---|---|
| Kidney Ca Nuclear grade 1/2 (OD04339) | 28.9 | Ovarian Cancer | 17.7 |
| Kidney Margin (OD04339) | 79.6 | Ovarian Cancer (OD04768-07) | 24.0 |
| Kidney Ca, Clear cell type (OD04340) | 39.2 | Ovary Margin (OD04768-08) | 13.5 |
| Kidney Margin (OD04340) | 90.8 | Normal Stomach | 14.9 |
| Kidney Ca, Nuclear grade 3 (OD04348) | 5.7 | Gastric Cancer 9060358 | 5.0 |
| Kidney Margin (OD04348) | 59.0 | Stomach Margin 9060359 | 20.3 |
| Kidney Cancer (OD04622-01) | 14.9 | Gastric Cancer 9060395 | 13.9 |
| Kidney Margin (OD04622-03) | 15.1 | Stomach Margin 9060394 | 23.3 |
| Kidney Cancer (OD04450-01) | 22.4 | Gastric Cancer 9060397 | 22.1 |
| Kidney Margin (OD04450-03) | 59.0 | Stomach Margin 9060396 | 5.8 |
| Kidney Cancer 8120607 | 28.5 | Gastric Cancer 064005 | 9.5 |

TABLE KD

Panel 4D

| Tissue Name | Rel. Exp. (%) Ag1911, Run 155311726 | Tissue Name | Rel. Exp. (%) Ag1911, Run 155311726 |
|---|---|---|---|
| Secondary Th1 act | 2.8 | HUVEC IL-1beta | 2.4 |
| Secondary Th2 act | 2.7 | HUVEC IFN gamma | 5.9 |
| Secondary Tr1 act | 6.1 | HUVEC TNF alpha + IFN gamma | 2.4 |
| Secondary Th1 rest | 1.4 | HUVEC TNF alpha + IL4 | 3.8 |
| Secondary Th2 rest | 2.7 | HUVEC IL-11 | 2.0 |
| Secondary Tr1 rest | 3.0 | Lung Microvascular EC none | 2.4 |
| Primary Th1 act | 1.5 | Lung Microvascular EC TNF alpha + IL-1beta | 3.7 |
| Primary Th2 act | 3.0 | Microvascular Dermal EC none | 7.1 |
| Primary Tr1 act | 1.9 | Microsvascular Dermal EC TNF alpha + IL-1beta | 3.3 |
| Primary Th1 rest | 4.5 | Bronchial epithelium TNF alpha + IL1beta | 0.7 |
| Primary Th2 rest | 4.1 | Small airway epithelium none | 1.2 |
| Primary Tr1 rest | 1.3 | Small airway epithelium TNF alpha + IL-1beta | 3.0 |
| CD45RA CD4 lymphocyte act | 7.1 | Coronery artery SMC rest | 6.7 |
| CD45RO CD4 lymphocyte act | 2.7 | Coronery artery SMC TNF alpha + IL-1beta | 5.8 |
| CD8 lymphocyte act | 1.6 | Astrocytes rest | 5.6 |
| Secondary CD8 lymphocyte rest | 0.9 | Astrocytes TNF alpha + IL-1beta | 6.2 |
| Secondary CD8 lymphocyte act | 4.1 | KU-812 (Basophil) rest | 0.3 |
| CD4 lymphocyte none | 1.1 | KU-812 (Basophil) PMA/ionomycin | 2.6 |
| 2ry Th1/Th2/Tr1_anti-CD95 CH11 | 2.6 | CCD1106 (Keratinocytes) none | 1.6 |
| LAK cells rest | 6.4 | CCD1106 (Keratinocytes) TNF alpha + IL-1beta | 1.4 |
| LAK cells IL-2 | 5.9 | Liver cirrhosis | 4.9 |
| LAK cells IL-2 + IL-12 | 1.7 | Lupus kidney | 3.4 |
| LAK cells IL-2 + IFN gamma | 3.3 | NCI-H292 none | 12.2 |
| LAK cells IL-2 + IL-18 | 1.7 | NCI-H292 IL-4 | 26.2 |
| LAK cells PMA/ionomycin | 9.0 | NCI-H292 IL-9 | 19.2 |
| NK Cells IL-2 rest | 3.6 | NCI-H292 IL-13 | 13.1 |
| Two Way MLR 3 day | 4.9 | NCI-H292 IFN gamma | 20.6 |
| Two Way MLR 5 day | 1.7 | HPAEC none | 3.6 |
| Two Way MLR 7 day | 1.4 | HPAEC TNF alpha + IL-1 beta | 6.2 |
| PBMC rest | 1.2 | Lung fibroblast none | 7.0 |

TABLE KD-continued

Panel 4D

| Tissue Name | Rel. Exp. (%) Ag1911, Run 155311726 | Tissue Name | Rel. Exp. (%) Ag1911, Run 155311726 |
|---|---|---|---|
| PBMC PWM | 5.7 | Lung fibroblast TNF alpha + IL-1beta | 10.9 |
| PBMC PHA-L | 1.7 | Lung fibroblast IL-4 | 6.9 |
| Ramos (B cell) none | 0.8 | Lung fibroblast IL-9 | 3.1 |
| Ramos (B cell) ionomycin | 2.6 | Lung fibroblast IL-13 | 3.1 |
| B lymphocytes PWM | 2.4 | Lung fibroblast IFN gamma | 10.6 |
| B lymphocytes CD40L and IL-4 | 0.4 | Dermal fibroblast CCD1070 rest | 14.2 |
| EOL-1 dbcAMP | 0.4 | Dermal fibroblast CCD1070 TNF alpha | 28.9 |
| EOL-1 dbcAMP PMA/ionomycin | 1.5 | Dermal fibroblast CCD1070 IL-1beta | 11.8 |
| Dendritic cells none | 3.7 | Dermal fibroblast IFN gamma | 1.6 |
| Dendritic cells LPS | 3.3 | Dermal fibroblast IL-4 | 2.3 |
| Dendritic cells anti-CD40 | 4.2 | IBD Colitis 2 | 1.1 |
| Monocytes rest | 1.0 | IBD Crohn's | 3.0 |
| Monocytes LPS | 3.4 | Colon | 12.4 |
| Macrophages rest | 6.9 | Lung | 14.8 |
| Macrophages LPS | 4.6 | Thymus | 100.0 |
| HUVEC none | 4.1 | Kidney | 15.1 |
| HUVEC starved | 8.2 | | |

Panel 1.3D Summary: Ag1911 This gene is expressed at moderate levels in all CNS regions examined, with highest expression in the hippocampus (CT=28.4). This gene encodes a protein that is homologous to GABA-A receptor associated protein which has a known brain—preferential distribution. The GABA system has been implicated in many neurological and psychiatric disorders including epilepsy, bipolar disorder, and schizophrenia. Interestingly, at least one antiepileptic that works by increasing GABA levels-Valproic acid- is also effective in the treatment of bipolar disorder. Similarly, bipolar disorder and schizophrenia share the common neuropathology of decreased glutamic acid decarboxylase production, the enzyme that converts the excitatory neurotransmitter glutamate into the inhibitory GABA. Therefore, the protein encoded by this gene may potentially interact with the major receptor for the major inhibitor in the brain, and is an excellent drug target for any of these diseases. Potentiation of this protein to increase GABA currents may also function as an anxiolytic, in addition to alleviating the symptoms of the above disorders.

This gene is expressed at low but significant levels in the cancer cell lines in this panel. Thus, expression of the gene could be used as a marker for brain and prostate cancer, as cell lines derived from these tissues seem to have decreased expression compared to normal tissues. This gene is also expressed in melanoma samples that may be indicative of the neural origin of these cancer cell lines.

Among tissues with metabolic function, this gene is expressed in pancreas, thyroid, pituitary, adult and fetal heart, adult and fetal skeletal muscle, adult and fetal liver, and adipose. This widespread expression suggests that this gene product may be an antibody target for the treatment of metabolic diseases, including obesity and Types 1 and 2 diabetes.

Recent postmortem studies have demonstrated subtle alterations in the hippocampal formation (HIPP) of patients with schizophrenia (SZ). These changes include a decreased density of nonpyramidal neurons (NPs), an increase of the GABA-A, but not benzodiazepine receptors and a neuroleptic-dose-related increase of GAD65-IR terminals, particularly in sectors CA3 and CA2. High resolution studies of the GABA-A receptor have further suggested that a decrease of disinhibitory GABAergic activity (i.e., GABA-to-GABA) in stratum pyramidale of CA3 may coexist with reduced inhibitory modulation (i.e., GABA-to-excitatory pyramidal neuron) in the stratum oriens of this same sector. These changes could potentially involve excitotoxic damage to interneurons in CA2; but, the precise time frame for the induction of such an injury during pre-versus postnatal life cannot as yet be inferred from the available data. These findings are consistent with reports of abnormal oscillatory rhythms and increased basal metabolic activity in the HIPP of patients with SZ. The fact that patients with manic depression also show a decrease of NPs in CA2 suggests that changes in the GABA system may not be related to a susceptibility gene for SZ. Rather, these alterations could be associated with a nonspecific factor, such as stress, experienced either early in life or much later during adolescence or adulthood. Presumably, there are also changes associated in other transmitter systems that may play a more specific role in establishing the SZ phenotype. See Benes, F. M., Biol. Psychiatry, 1999 Sep. 1; 46(5):589–99.

Neurobiological studies indicate a dysregulation of the dopaminergic and GABAergic neurotransmission in bipolar disorder. Two large families segregating bipolar disorder were examined for linkage with the genes encoding dopamine beta-hydroxylase, the dopamine transporter DAT1, the dopamine D2, D3 and D5 receptors, and the alpha-1, alpha-5 and beta-1 subunits of the GABAA receptor. Under at least one diagnostic model one of the two families provided evidence to exclude linkage for the DAT1, DRD2, DRD3, DRD5, DBH, GABRA1 and GABARB1 genes but could not exclude the GABRA5 locus. A second family excluded only the GABRA1 and GABRA5 loci at zero recombination and could not formally reject linkage at the DBH, DRD2, DRD3, DRD5, DAT1 and GABARB1 loci. See Debruyn, A., et al., Psychiatr Genet, 1996 Summer; 6(2):67–73.

Gamma-Aminobutyric acid (GABA), the principal inhibitory neurotransmitter in the cerebral cortex, maintains the inhibitory tone that counterbalances neuronal excitation.

When this balance is perturbed, seizures may ensue. GABA is formed within GABAergic axon terminals and released into the synapse, where it acts at one of two types of receptor: GABA-A, which controls chloride entry into the cell, and GABA-B, which increases potassium conductance, decreases calcium entry, and inhibits the presynaptic release of other transmitters. GABA-A-receptor binding influences the early portion of the GABA-mediated inhibitory postsynaptic potential, whereas GABA-B binding influences the late portion. GABA is rapidly removed by uptake into both glia and presynaptic nerve terminals and then catabolized by GABA transaminase. Experimental and clinical study evidence indicates that GABA has an important role in the mechanism and treatment of epilepsy: (a) abnormalities of GABAergic function have been observed in genetic and acquired animal models of epilepsy; (b) reductions of GABA-mediated inhibition, activity of glutamate decarboxylase, binding to GABA-A and benzodiazepine sites, GABA in cerebrospinal fluid and brain tissue, and GABA detected during microdialysis studies have been reported in studies of human epileptic brain tissue; (c) GABA agonists suppress seizures, and GABA antagonists produce seizures; (d) drugs that inhibit GABA synthesis cause seizures; and (e) benzodiazepines and barbiturates work by enhancing GABA-mediated inhibition. Finally, drugs that increase synaptic GABA are potent anticonvulsants. Two recently developed antiepileptic drugs (AEDs), vigabatrin (VGB) and tiagabine (TGB), are examples of such agents. However, their mechanisms of action are quite different (VGB is an irreversible suicide inhibitor of GABA transaminase, whereas TGB blocks GABA reuptake into neurons and glia), which may account for observed differences in drug side-effect profile. See Treiman D. M., *Epilepsia* 2001 ; 42 Suppl 3:8–12.

Panel 2D Summary: Ag1911 This gene is rather ubiquitously expressed at low levels in all the tissue samples on this panel. The highest level of expression is seen in a kiney cancer sample (CT=30.14). There is slightly higher expression in normal tissues derived from colon, kidney, thyroid and gastric samples than the matched cancer tissues. Thus, this gene may be used as a marker to differentiate between normal and cancerous tissues. Given the central role of this molecule in regulating signal transduction, it is a promising target for therapeutic modulation in certain cancers.

Type-A receptors for the neurotransmitter GABA (gamma-aminobutyric acid) are ligand-gated chloride channels that mediate inhibitory neurotransmission. Each subunit of the pentameric receptor protein has ligand-binding sites in the amino-terminal extracellular domain and four membrane-spanning regions, one of which forms a wall of the ion channel. Each subunit also has a large intracellular loop that may be a target for protein kinases and be required for subcellular targeting and membrane clustering of the receptor, perhaps by anchoring the receptor to the cytoskeleton. Neurotransmitter receptors need to be positioned in high density in the cell membrane at sites postsynaptic to nerve terminals releasing that neurotransmitter. Other members of the superfamily of ligand-gated ion-channel receptors associate in postsynaptic-membrane clusters by binding to the proteins rapsyn or gephyrin. The recently identified cellular protein, GABA(A)-receptor-associated protein (GABARAP), interacts with the gamma2 subunit of GABA (A) receptors. GABARAP binds to GABA(A) receptors both in vitro and in vivo, and co-localizes with the punctate staining of GABA(A) receptors on cultured cortical neurons. Sequence analysis shows similarity between GABARAP and light chain-3 of microtubule-associated proteins 1A and 1B. Moreover, the N terminus of GABARAP is highly positively charged and features a putative tubulin-binding motif. The interactions among GABA(A) receptors, GABARAP and tubulin suggest a mechanism for the targeting and clustering of GABA(A)receptors. See Wang, H., et al., *Nature*, 1999 Jan. 7; 397(6714):69–72.

Panel 4D Summary: This gene encodes a GABA-receptor-associated protein-like protein and is expressed at moderate levels (CT=30–33) in most cells types represented on this panel, with highest expression in thymus (CT=28.2). The GABA-receptor-associated protein-like protein may be involved in intracellular receptor transport in neuronal or non-neuronal cells in the thymus. Drugs that inhibit the function of this gene product may reduce or eliminate the symptoms of autoimmune or inflammatory diseases that depend on the T cells that develop in the thymus, such as asthma, allergies, inflammatory bowel disease, lupus erythematosus, or rheumatoid arthritis.

GABA(A) receptors, the major sites of fast synaptic inhibition in the brain, are composed predominately of alpha, beta, and gamma2 subunits. The receptor gamma2 subunit interacts with a 17-kDa microtubule associated protein GABARAP, but the significance of this interaction remains unknown. GABARAP, which immunoprecipitates with GABA(A) receptors, is not found at significant levels within inhibitory synapses, but is enriched within the Golgi apparatus and postsynaptic cisternae. GABARAP binds directly to N-ethylmaleimide-sensitive factor (NSF), a protein critical for intracellular membrane trafficking events. NSF and GABARAP complexes were detected in neurons and these two proteins also colocalize within intracellular membrane compartments. These observations suggest that GABARAP may play a role in intracellular GABA(A) receptor transport but not synaptic anchoring, via its ability to interact with NSF. GABARAP may therefore have an important role in the production of GABAergic synapses. See Kittler, J. T., et al., *Mol Cell Neurosci,* 2001 July; 18(1): 13–25.

The specific localization of gamma-aminobutyric acid-transaminase (GABA-t) in the thymus of young and elderly men shows a specific vascular localization of GABA-t in the human thymus, and the amount and distribution of GABA-t changes with age. In a recent study, samples of human thymus were harvested throughout of 12 autopsies in infants (n=3), as well as young (n=3), adult (n=3) and elderly (n=3) men. Histologic staining of the human thymus was performed with eosin-orange, while histologic staining of nerve fibers was performed with the Bodian method. Histochemical and biochemical demonstration of GABA-t, including protein dosage, was performed by the methods of Van Gelder and Jung, respectively. Finally, quantitative analysis of images was performed. Staining with eosin-orange reveals the micro-anatomical details of the thymic microenvironment. The Bodian method shows the nerve fibers and neurofibrils. Histochemical staining for GABA-t shows an increase of this enzyme with age and a marked localization in the nerve fibers of the thymus in infant, young, adult, and elderly men, as well as specific vascular localization of this enzyme. Finally, quantitative analysis of images performed on slices confirmed all the morphological changes induced by age. These studies suggest that GABA is an inhibitory neurotransmitter of the human thymus, while GABA-t plays an important role in GABA metabolism. See Cavallotti, D., et al., *Hum Immunol,* 1999 November; 60(11): 1072–9.

L. NOV17

AC004596__A: CG13379-Like

Expression of gene AC004596__A was assessed using the primer-probe sets Ag1908 and Ag2045, described in Tables LA and LB. Results of the RTQ-PCR runs are shown in Tables LC and LD.

TABLE LA

Probe Name Ag1908

| Primers | Sequences | Length | Start Position | SEQ ID NO |
|---|---|---|---|---|
| Forward | 5'-atggtatctcccattccagaac-3' | 22 | 600 | 208 |
| Probe | TET-5'-caattcccctcgaagatccaagtcat-3'-TAMRA | 26 | 624 | 209 |
| Reverse | 5'-aaggatccgaattgctaagttc-3' | 22 | 667 | 210 |

TABLE LB

Probe Name Ag2045

| Primers | Sequences | Length | Start Position | SEQ ID NO |
|---|---|---|---|---|
| Forward | 5'-atggtatctcccattccagaac-3' | 22 | 600 | 211 |
| Probe | TET-5'-caattcccctcgaagatccaagtcat-3'-TAMRA | 26 | 624 | 212 |
| Reverse | 5'-aaggatccgaattgctaagttc-3' | 22 | 667 | 213 |

TABLE LC

Panel 1.3D

| Tissue Name | Rel. Exp. (%) Ag1908, Run 147570953 | Rel. Exp. (%) Ag2045, Run 165627342 | Tissue Name | Rel. Exp. (%) Ag1908, Run 147570953 | Rel. Exp. (%) Ag2045, Run 165627342 |
|---|---|---|---|---|---|
| Liver adenocarcinoma | 7.5 | 10.1 | Kidney (fetal) | 3.3 | 10.8 |
| Pancreas | 3.5 | 5.2 | Renal ca. 786-0 | 1.9 | 6.7 |
| Pancreatic ca. CAPAN 2 | 1.7 | 12.3 | Renal ca. A498 | 7.7 | 14.6 |
| Adrenal gland | 5.8 | 2.7 | Renal ca. RXF 393 | 2.6 | 20.3 |
| Thyroid | 5.5 | 9.9 | Renal ca. ACHN | 7.9 | 8.4 |
| Salivary gland | 4.1 | 7.1 | Renal ca. UO-31 | 3.7 | 9.6 |
| Pituitary gland | 13.7 | 11.3 | Renal ca. TK-10 | 3.0 | 5.1 |
| Brain (fetal) | 10.2 | 33.7 | Liver | 1.3 | 5.2 |
| Brain (whole) | 24.7 | 100.0 | Liver (fetal) | 4.0 | 5.3 |
| Brain (amygdala) | 28.5 | 64.6 | Liver ca. (hepatoblast) HepG2 | 8.2 | 20.2 |
| Brain (cerebellum) | 6.4 | 45.7 | Lung | 6.6 | 10.2 |
| Brain (hippocampus) | 45.7 | 79.6 | Lung (fetal) | 6.8 | 12.9 |
| Brain (substantia nigra) | 5.3 | 25.2 | Lung ca. (small cell) LX-1 | 7.2 | 16.7 |
| Brain (thalamus) | 22.2 | 90.1 | Lung ca. (small cell) NCI-H69 | 7.2 | 6.8 |
| Cerebral Cortex | 100.0 | 79.0 | Lung ca. (s.cell var.) SHP-77 | 7.9 | 14.6 |
| Spinal cord | 6.7 | 24.1 | Lung ca. (large cell)NCI-H460 | 3.7 | 24.7 |
| glio/astro U87-MG | 3.4 | 9.5 | Lung ca. (non-sm. cell) A549 | 3.7 | 15.0 |
| glio/astro U-118-MG | 14.7 | 33.9 | Lung ca. (non-s.cell) NCI-H23 | 7.3 | 1.2 |
| astrocytoma SW1783 | 4.7 | 8.9 | Lung ca. (non-s.cell) HOP-62 | 7.0 | 18.0 |
| neuro*; met SK-N-AS | 20.7 | 24.5 | Lung ca. (non-s.cl) NCI-H522 | 7.5 | 12.2 |
| astrocytoma SF-539 | 4.0 | 10.8 | Lung ca. (squam.) SW 900 | 1.4 | 5.0 |
| astrocytoma SNB-75 | 14.6 | 13.1 | Lung ca. (squam.) NCI-H596 | 3.2 | 8.2 |
| glioma SNB-19 | 5.5 | 13.0 | Mammary gland | 7.6 | 11.2 |
| glioma U251 | 3.1 | 17.7 | Breast ca.* (pl.ef) MCF-7 | 4.8 | 5.7 |

TABLE LC-continued

Panel 1.3D

| Tissue Name | Rel. Exp. (%) Ag1908, Run 147570953 | Rel. Exp. (%) Ag2045, Run 165627342 | Tissue Name | Rel. Exp. (%) Ag1908, Run 147570953 | Rel. Exp. (%) Ag2045, Run 165627342 |
|---|---|---|---|---|---|
| glioma SF-295 | 9.9 | 19.8 | Breast ca.* (pl.ef) MDA-MB-231 | 10.5 | 25.5 |
| Heart (Fetal) | 20.9 | 8.3 | Breast ca.* (pl. ef) T47D | 6.9 | 7.6 |
| Heart | 2.4 | 8.8 | Breast ca. BT-549 | 6.7 | 7.2 |
| Skeletal muscle (Fetal) | 27.0 | 4.8 | Breast ca. MDA-N | 3.9 | 0.0 |
| Skeletal muscle | 1.8 | 18.0 | Ovary | 7.0 | 6.6 |
| Bone marrow | 4.7 | 10.7 | Ovarian ca. OVCAR-3 | 8.2 | 13.7 |
| Thymus | 4.2 | 12.7 | Ovarian ca. OVCAR-4 | 1.1 | 6.0 |
| Spleen | 10.4 | 29.9 | Ovarian ca. OVCAR-5 | 5.6 | 10.2 |
| Lymph node | 7.3 | 20.3 | Ovarian ca. OVCAR-8 | 6.4 | 16.6 |
| Colorectal | 5.2 | 8.2 | Ovarian ca. IGROV-1 | 1.3 | 0.2 |
| Stomach | 7.5 | 27.5 | Ovarian ca. (ascites) SK-OV-3 | 4.8 | 9.0 |
| Small intestine | 5.2 | 17.1 | Uterus | 7.3 | 20.0 |
| Colon ca. SW480 | 6.0 | 7.1 | Placenta | 12.5 | 11.8 |
| Colon ca.* SW620 (SW480 met) | 3.0 | 6.0 | Prostate | 3.4 | 6.5 |
| Colon ca. HT29 | 4.9 | 4.0 | Prostate ca.* (bone met) PC-3 | 10.4 | 32.8 |
| Colon ca. HCT-116 | 3.5 | 6.0 | Testis | 12.9 | 21.8 |
| Colon ca. CaCo-2 | 7.9 | 6.3 | Melanoma Hs688(A).T | 13.3 | 3.6 |
| CC Well to Mod Diff (ODO3866) | 4.7 | 12.4 | Melanoma* (met) Hs688(B).T | 19.8 | 2.9 |
| Colon ca. HCC-2998 | 7.3 | 6.2 | Melanoma UACC-62 | 1.4 | 8.7 |
| Gastric ca. (liver met) NCI-N87 | 15.8 | 15.1 | Melanoma M14 | 2.1 | 13.7 |
| Bladder | 2.3 | 5.9 | Melanoma LOX IMVI | 3.3 | 6.6 |
| Trachea | 7.5 | 13.6 | Melanoma* (met) SK-MEL-5 | 0.9 | 10.4 |
| Kidney | 1.5 | 8.3 | Adipose | 3.5 | 6.7 |

TABLE LD

Panel 4D

| Tissue Name | Rel. Exp. (%) Ag1908, Run 159550638 | Rel. Exp. (%) Ag2045, Run 161383474 | Tissue Name | Rel. Exp. (%) Ag1908, Run 159550638 | Rel. Exp. (%) Ag2045, Run 161383474 |
|---|---|---|---|---|---|
| Secondary Th1 act | 25.7 | 39.8 | HUVEC IL-1beta | 15.0 | 8.6 |
| Secondary Th2 act | 31.0 | 42.6 | HUVEC IFN gamma | 31.2 | 33.0 |
| Secondary Tr1 act | 46.0 | 42.9 | HUVEC TNF alpha + IFN gamma | 17.7 | 26.8 |
| Secondary Th1 rest | 15.6 | 18.0 | HUVEC TNF alpha + IL4 | 32.5 | 29.7 |
| Secondary Th2 rest | 20.4 | 22.2 | HUVEC IL-11 | 17.4 | 22.7 |
| Secondary Tr1 rest | 22.7 | 20.6 | Lung Microvascular EC none | 25.3 | 22.5 |
| Primary Th1 act | 37.1 | 44.4 | Lung Microvascular EC TNF alpha + IL-1beta | 28.5 | 34.9 |
| Primary Th2 act | 26.4 | 42.0 | Microvascular Dermal EC none | 24.5 | 47.3 |
| Primary Tr1 act | 66.9 | 48.0 | Microvascular Dermal EC TNF alpha + IL-1beta | 22.5 | 33.9 |

TABLE LD-continued

Panel 4D

| Tissue Name | Rel. Exp. (%) Ag1908, Run 159550638 | Rel. Exp. (%) Ag2045, Run 161383474 | Tissue Name | Rel. Exp. (%) Ag1908, Run 159550638 | Rel. Exp. (%) Ag2045, Run 161383474 |
|---|---|---|---|---|---|
| Primary Th1 rest | 39.0 | 72.7 | Bronchial epithelium TNF alpha + IL1beta | 4.0 | 8.2 |
| Primary Th2 rest | 24.8 | 32.3 | Small airway epithelium none | 14.2 | 13.6 |
| Primary Tr1 rest | 21.5 | 25.9 | Small airway epithelium TNF alpha + IL-1beta | 43.5 | 57.0 |
| CD45RA CD4 lymphocyte act | 27.2 | 22.4 | Coronery artery SMC rest | 20.9 | 31.2 |
| CD45RO CD4 lymphocyte act | 17.9 | 38.7 | Coronery artery SMC TNF alpha + IL-1beta | 11.7 | 23.5 |
| CD8 lymphocyte act | 25.5 | 39.2 | Astrocytes rest | 17.0 | 27.0 |
| Secondary CD8 lymphocyte rest | 24.7 | 51.1 | Astrocytes TNF alpha + IL-1beta | 9.9 | 23.2 |
| Secondary CD8 lymphocyte act | 10.4 | 25.3 | KU-812 (Basophil) rest | 15.1 | 21.2 |
| CD4 lymphocyte none | 6.9 | 14.0 | KU-812 (Basophil) PMA/ionomycin | 44.8 | 54.3 |
| 2ry Th1/Th2/Tr1_anti-CD95 CH11 | 13.8 | 26.6 | CCD1106 (Keratinocytes) none | 34.9 | 30.1 |
| LAK cells rest | 11.7 | 24.0 | CCD1106 (Keratinocytes) TNF alpha + IL-1beta | 4.0 | 3.6 |
| LAK cells IL-2 | 27.9 | 44.8 | Liver cirrhosis | 8.0 | 3.4 |
| LAK cells IL-2 + IL-12 | 17.3 | 38.4 | Lupus kidney | 4.8 | 9.0 |
| LAK cells IL-2 + IFN gamma | 26.2 | 47.0 | NCI-H292 none | 30.8 | 58.6 |
| LAK cells IL-2 + IL-18 | 24.3 | 39.5 | NCI-H292 IL-4 | 25.9 | 42.6 |
| LAK cells PMA/ionomycin | 25.0 | 33.9 | NCI-H292 IL-9 | 39.8 | 60.7 |
| NK Cells IL-2 rest | 24.0 | 24.1 | NCI-H292 IL-13 | 13.6 | 30.4 |
| Two Way MLR 3 day | 21.6 | 50.3 | NCI-H292 IFN gamma | 24.8 | 43.8 |
| Two Way MLR 5 day | 14.6 | 24.1 | HPAEC none | 16.6 | 32.8 |
| Two Way MLR 7 day | 22.1 | 27.5 | HPAEC TNF alpha + IL-1beta | 25.9 | 30.8 |
| PBMC rest | 10.3 | 24.3 | Lung fibroblast none | 19.1 | 33.4 |
| PBMC PWM | 50.0 | 93.3 | Lung fibroblast TNF alpha + IL-1 beta | 13.8 | 25.7 |
| PBMC PHA-L | 26.6 | 42.3 | Lung fibroblast IL-4 | 41.8 | 72.2 |
| Ramos (B cell) none | 42.0 | 51.4 | Lung fibroblast IL-9 | 46.7 | 43.2 |
| Ramos (B cell) ionomycin | 37.6 | 100.0 | Lung fibroblast IL-13 | 32.1 | 44.1 |
| B lymphocytes PWM | 100.0 | 88.3 | Lung fibroblast IFN gamma | 62.9 | 73.2 |
| B lymphocytes CD40L and IL-4 | 42.0 | 50.0 | Dermal fibroblast CCD1070 rest | 57.8 | 47.0 |
| EOL-1 dbcAMP | 24.3 | 36.6 | Dermal fibroblast CCD1070 TNF alpha | 93.3 | 96.6 |
| EOL-1 dbcAMP PMA/ionomycin | 26.6 | 66.9 | Dermal fibroblast CCD1070 IL-1 beta | 28.9 | 23.5 |
| Dendritic cells none | 21.8 | 34.6 | Dermal fibroblast IFN gamma | 12.4 | 13.1 |
| Dendritic cells LPS | 25.3 | 41.8 | Dermal fibroblast IL-4 | 35.1 | 34.6 |

TABLE LD-continued

Panel 4D

| Tissue Name | Rel. Exp. (%) Ag1908, Run 159550638 | Rel. Exp. (%) Ag2045, Run 161383474 | Tissue Name | Rel. Exp. (%) Ag1908, Run 159550638 | Rel. Exp. (%) Ag2045, Run 161383474 |
|---|---|---|---|---|---|
| Dendritic cells anti-CD40 | 27.7 | 27.4 | IBD Colitis 2 | 2.4 | 1.0 |
| Monocytes rest | 25.5 | 41.5 | IBD Crohn's | 5.4 | 4.7 |
| Monocytes LPS | 28.1 | 47.6 | Colon | 27.4 | 40.3 |
| Macrophages rest | 25.0 | 50.0 | Lung | 17.4 | 41.2 |
| Macrophages LPS | 14.5 | 46.3 | Thymus | 29.1 | 22.1 |
| HUVEC none | 21.6 | 51.1 | Kidney | 37.9 | 47.6 |
| HUVEC starved | 33.7 | 59.5 | | | |

Panel 1.3D Summary: Ag1908/2045 Two experiments with the same probe and primer set show brain preferential expression of this gene, with highest expression in the cerebral cortex and the whole brain (CTs=29–30). This expression profile suggests that the protein encoded by this gene may be of use in treating neurological and psychiatric disorders.

This gene is moderately expressed in a wide variety of metabolic tissues including pancreas, adrenal, thyroid, pituitary, adult and fetal heart, adult and fetal skeletal muscle, adult and fetal liver, and adipose. Thus, this gene product may be important in the pathogenesis, diagnosis, and/or treatment of metabolic disease, including obesity and Types 1 and 2 diabetes.

Overall, this gene is ubiquitously expressed at a low level in all tissues used in this panel. There is good concordance in both runs for increased expression in prostate cancer cell lines compared to the normal prostate tissue. Thus expression of this gene may be used as a marker for prostate cancer. The overall expression pattern suggests that this gene is required for the survival and proliferation of the majority of cell types.

Panel 4D Summary: Ag1908/2045 This gene is moderately expressed in a wide variety of immune cell types and tissues, including T cells, B cells, monocytes, and dendritic cells. This widespread expression suggests that the gene product may be important in the pathogenesis, diagnosis, and/or treatment of autoimmune and inflammatory diseases such as asthma, allergies, inflammatory bowel disease, lupus erythematosus, or rheumatoid arthritis.

M. NOV16
CG59189-01/61116029_GRAIL: P450-Like

Expression of gene CG59189-01 was assessed using the primer-probe set Ag3389, described in Table MA. Results of the RTQ-PCR runs are shown in Tables MB, MC and MD.

TABLE MA

Probe Name Ag3389

| Primers | Sequences | Length | Start Position | SEQ ID NO |
|---|---|---|---|---|
| Forward | 5'-agacattccaggggacagaa-3' | 20 | 473 | 214 |
| Probe | TET-5'-cattcgatccctccctgctgctg-3'-TAMRA | 23 | 500 | 215 |
| Reverse | 5'-caaagaggagggagcagactac-3' | 22 | 541 | 216 |

TABLE MB

CNS_neurodegeneration_v1.0

| Tissue Name | Rel. Exp. (%) Ag3389, Run 210347074 | Tissue Name | Rel. Exp. (%) Ag3389, Run 210347074 |
|---|---|---|---|
| AD 1 Hippo | 23.7 | Control (Path) 3 Temporal Ctx | 0.0 |
| AD 2 Hippo | 49.7 | Control (Path) 4 Temporal Ctx | 10.0 |
| AD 3 Hippo | 0.0 | AD 1 Occipital Ctx | 32.8 |
| AD 4 Hippo | 5.4 | AD 2 Occipital Ctx (Missing) | 0.0 |
| AD 5 Hippo | 94.6 | AD 3 Occipital Ctx | 11.3 |
| AD 6 Hippo | 28.9 | AD 4 Occipital Ctx | 0.0 |
| Control 2 Hippo | 46.3 | AD 5 Occipital Ctx | 20.6 |
| Control 4 Hippo | 39.5 | AD 5 Occipital Ctx | 7.0 |
| Control (Path) 3 Hippo | 11.0 | Control 1 Occipital Ctx | 9.7 |
| AD 1 Temporal Ctx | 14.6 | Control 2 Occipital Ctx | 51.8 |
| AD 2 Temporal Ctx | 8.8 | Control 3 Occipital Ctx | 10.7 |
| AD 3 Temporal Ctx | 21.5 | Control 4 Occipital Ctx | 25.5 |

TABLE MB-continued

CNS_neurodegeneration_v1.0

| Tissue Name | Rel. Exp. (%) Ag3389, Run 210347074 | Tissue Name | Rel. Exp. (%) Ag3389, Run 210347074 |
|---|---|---|---|
| AD 4 Temporal Ctx | 10.1 | Control (Path) 1 Occipital Ctx | 43.2 |
| AD 5 Inf Temporal Ctx | 100.0 | Control (Path) 2 Occipital Ctx | 0.0 |
| AD 5 Sup Temporal Ctx | 38.4 | Control (Path) 3 Occipital Ctx | 0.0 |
| AD 6 Inf Temporal Ctx | 53.6 | Control (Path) 4 Occipital Ctx | 9.3 |
| AD 6 Sup Temporal Ctx | 80.7 | Control 1 Parietal Ctx | 0.0 |
| Control 1 Temporal Ctx | 0.0 | Control 2 Parietal Ctx | 27.2 |
| Control 2 Temporal Ctx | 48.3 | Control 3 Parietal Ctx | 16.6 |
| Control 3 Temporal Ctx | 27.7 | Control (Path) 1 Parietal Ctx | 37.1 |
| Control 3 Temporal Ctx | 6.3 | Control (Path) 2 Parietal Ctx | 15.6 |
| Control (Path) 1 Temporal Ctx | 44.1 | Control (Path) 3 Parietal Ctx | 0.0 |
| Control (path) 2 Temporal Ctx | 0.0 | Control (Path) 4 Parietal Ctx | 48.6 |

TABLE MC

General_screening_panel_v1.4

| Tissue Name | Rel. Exp. (%) Ag3389, Run 216822055 | Tissue Name | Rel. Exp. (%) Ag3389, Run 216822055 |
|---|---|---|---|
| Adipose | 0.1 | Renal ca. TK-10 | 2.4 |
| Melanoma* Hs688(A).T | 0.0 | Bladder | 2.6 |
| Melanoma* Hs688(B).T | 0.0 | Gastric ca. (liver met.) NCI-N87 | 2.5 |
| Melanoma* M14 | 0.2 | Gastric ca. KATO III | 100.0 |
| Melanoma* LOXIMVI | 0.0 | Colon ca. SW-948 | 23.7 |
| Melanoma* SK-MEL-5 | 0.1 | Colon ca. SW480 | 7.1 |
| Squamous cell carcinoma SCC-4 | 1.7 | Colon ca.* (SW480 met) SW620 | 5.3 |
| Testis Pool | 0.1 | Colon ca. HT29 | 10.1 |
| Prostate ca.* (bone met) PC-3 | 1.1 | Colon ca. HCT-116 | 5.3 |
| Prostate Pool | 0.1 | Colon ca. CaCo-2 | 18.0 |
| Placenta | 0.5 | Colon cancer tissue | 24.0 |
| Uterus Pool | 0.0 | Colon ca. SW1116 | 6.1 |
| Ovarian ca. OVCAR-3 | 1.4 | Colon ca. Colo-205 | 6.1 |
| Ovarian ca. SK-OV-3 | 1.0 | Colon ca. SW-48 | 17.8 |
| Ovarian ca. OVCAR-4 | 4.3 | Colon Pool | 0.3 |
| Ovarian ca. OVCAR-5 | 7.6 | Small Intestine Pool | 0.3 |
| Ovarian ca. IGROV-1 | 0.6 | Stomach Pool | 0.5 |
| Ovarian ca. OVCAR-8 | 1.1 | Bone Marrow Pool | 0.3 |
| Ovary | 1.1 | Fetal Heart | 0.0 |
| Breast ca. MCF-7 | 0.6 | Heart Pool | 0.0 |
| Breast ca. MDA-MB-231 | 1.4 | Lymph Node Pool | 0.2 |
| Breast ca. BT 549 | 0.0 | Fetal Skeletal Muscle | 0.1 |
| Breast ca. T47D | 39.5 | Skeletal Muscle Pool | 0.1 |
| Breast ca. MDA-N | 0.0 | Spleen Pool | 0.7 |
| Breast Pool | 0.2 | Thymus Pool | 0.3 |
| Trachea | 2.7 | CNS cancer (glio/astro) U87-MG | 0.1 |
| Lung | 0.0 | CNS cancer (glio/astro) U-118-MG | 0.1 |
| Fetal Lung | 3.2 | CNS cancer (neuro; met) SK-N-AS | 0.0 |
| Lung ca. NCI-N417 | 0.0 | CNS cancer (astro) SF-539 | 0.0 |
| Lung ca. LX-1 | 4.0 | CNS cancer (astro) SNB-75 | 0.0 |
| Lung ca. NCI-H146 | 0.0 | CNS cancer (glio) SNB-19 | 0.7 |
| Lung ca. SHP-77 | 0.0 | CNS cancer (glio) SF-295 | 8.6 |
| Lung ca. A549 | 23.5 | Brain (Amygdala) Pool | 0.2 |
| Lung ca. NCI-H526 | 0.0 | Brain (cerebellum) | 0.0 |
| Lung ca. NCI-H23 | 1.4 | Brain (fetal) | 0.0 |
| Lung ca. NCI-H460 | 0.0 | Brain (Hippocampus) Pool | 0.1 |
| Lung ca. HOP-62 | 2.1 | Cerebral Cortex Pool | 0.0 |
| Lung ca. NCI-H522 | 0.1 | Brain (Substantia nigra) Pool | 0.3 |
| Liver | 0.3 | Brain (Thalamus) Pool | 0.2 |
| Fetal Liver | 0.4 | Brain (whole) | 0.1 |
| Liver ca. HepG2 | 3.1 | Spinal Cord Pool | 0.2 |
| Kidney Pool | 0.2 | Adrenal Gland | 0.2 |
| Fetal Kidney | 0.0 | Pituitary gland Pool | 0.2 |

TABLE MC-continued

General_screening_panel_v1.4

| Tissue Name | Rel. Exp. (%) Ag3389, Run 216822055 | Tissue Name | Rel. Exp. (%) Ag3389, Run 216822055 |
|---|---|---|---|
| Renal ca. 786-0 | 0.0 | Salivary Gland | 0.1 |
| Renal ca. A498 | 0.3 | Thyroid (female) | 0.4 |
| Renal ca. ACHN | 2.2 | Pancreatic ca. CAPAN2 | 1.6 |
| Renal ca. UO-31 | 4.3 | Pancreas Pool | 0.3 |

TABLE MD

Panel 4D

| Tissue Name | Rel. Exp. (%) Ag3389, Run 165296465 | Tissue Name | Rel. Exp. (%) Ag3389, Run 165296465 |
|---|---|---|---|
| Secondary Th1 act | 0.0 | HUVEC IL-1beta | 1.8 |
| Secondary Th2 act | 0.2 | HUVEC IFN gamma | 1.9 |
| Secondary Tr1 act | 0.0 | HUVEC TNF alpha + IFN gamma | 0.5 |
| Secondary Th1 rest | 0.0 | HUVEC TNF alpha + IL4 | 0.7 |
| Secondary Th2 rest | 0.0 | HUVEC IL-11 | 0.7 |
| Secondary Tr1 rest | 0.0 | Lung Microvascular EC none | 4.1 |
| Primary Th1 act | 0.0 | Lung Microvascular EC TNF alpha + IL-1beta | 2.7 |
| Primary Th2 act | 0.0 | Microvascular Dermal EC none | 5.2 |
| Primary Tr1 act | 0.2 | Microvasular Dermal EC TNF alpha + IL-1beta | 5.7 |
| Primary Th1 rest | 1.1 | Bronchial epithelium TNF alpha + IL1beta | 68.8 |
| Primary Th2 rest | 0.0 | Small airway epithelium none | 38.4 |
| Primary Tr1 rest | 0.0 | Small airway epithelium TNF alpha + IL-1beta | 100.0 |
| CD45RA CD4 lymphocyte act | 0.8 | Coronery artery SMC rest | 2.0 |
| CD45RO CD4 lymphocyte act | 0.0 | Coronery artery SMC TNF alpha + IL-1beta | 1.0 |
| CD8 lymphocyte act | 0.0 | Astrocytes rest | 0.0 |
| Secondary CD8 lymphocyte rest | 0.0 | Astrocytes TNF alpha + IL-1beta | 1.3 |
| Secondary CD8 lymphocyte act | 0.2 | KU-812 (Basophil) rest | 0.6 |
| CD4 lymphocyte none | 0.0 | KU-812 (Basophil) PMA/ionomycin | 0.4 |
| 2ry Th1/Th2/Tr1_anti-CD95 CH11 | 0.1 | CCD1106 (Keratinocytes) none | 9.3 |
| LAK cells rest | 8.4 | CCD1106 (Keratinocytes) TNF alpha + IL-1beta | 5.7 |
| LAK cells IL-2 | 0.0 | Liver cirrhosis | 0.4 |
| LAK cells IL-2 + IL-12 | 0.0 | Lupus Kidney | 0.0 |
| LAK cells IL-2 + IFN gamma | 0.5 | NCI-H292 none | 3.4 |
| LAK cells IL-2 + IL-18 | 0.2 | NCI-H292 IL-4 | 7.5 |
| LAK cells PMA/ionomycin | 5.4 | NCI-H292 IL-9 | 8.8 |
| NK Cells IL-2 rest | 0.0 | NCI-H292 IL-13 | 4.0 |
| Two Way MLR 3 day | 6.9 | NCI-H292 IFN gamma | 1.6 |
| Two Way MLR 5 day | 6.3 | HPAEC none | 0.5 |
| Two Way MLR 7 day | 0.7 | HPAEC TNF alpha + IL-1 beta | 0.3 |
| PBMC rest | 0.2 | Lung fibroblast none | 3.2 |
| PBMC PWM | 0.8 | Lung fibroblast TNF alpha + IL-1beta | 6.8 |
| PBMC PHA-L | 2.4 | Lung fibroblast IL-4 | 2.6 |
| Ramos (B cell) none | 0.0 | Lung fibroblast IL-9 | 2.6 |
| Ramos (B cell) ionomycin | 0.0 | Lung fibroblast IL-13 | 3.4 |
| B lymphocytes PWM | 0.8 | Lung fibroblast IFN gamma | 2.8 |
| B lymphocytes CD40L and IL-4 | 0.2 | Dermal fibroblast CCD1070 rest | 0.8 |
| EOL-1 dbcAMP | 0.0 | Dermal fibroblast CCD1070 TNF alpha | 1.1 |
| EOL-1 dbcAMP PMA/ionomycin | 0.2 | Dermal fibroblast CCD1070 IL-1beta | 0.0 |
| Dendritic cells none | 15.0 | Dermal fibroblast IFN gamma | 0.0 |
| Dendritic cells LPS | 10.3 | Dermal fibroblasts IL-4 | 0.0 |

TABLE MD-continued

Panel 4D

| Tissue Name | Rel. Exp. (%) Ag3389, Run 165296465 | Tissue Name | Rel. Exp. (%) Ag3389, Run 165296465 |
|---|---|---|---|
| Dendritic cells anti-CD40 | 17.2 | IBD Colitis 2 | 0.0 |
| Monocytes rest | 4.8 | IBD Crohn's | 0.7 |
| Monocytes LPS | 8.4 | Colon | 38.4 |
| Macrophages rest | 26.8 | Lung | 2.3 |
| Macrophages LPS | 20.2 | Thymus | 0.4 |
| HUVEC none | 2.5 | Kidney | 2.0 |
| HUVEC starved | 1.6 | | |

CNS_neurodegeneration_v1.0 Summary: Ag3389 No difference is detected in the expression of this gene in the postmortem brains of Alzheimer's patients when compared to normal controls; however, this panel demonstrates the expression of this gene in the CNS of an independent group of patients. See panel 1.4 for a discussion of utility in the central nervous system.

General_screening_panel_v1.4 Summary: Ag3389 Expression of this gene is highest in a gastric cancer cell line (CT=25.1). Overall, there is higher expression in cancer cell lines derived from prostate, ovary, breast, lung, kidney, stomach, brain, colon and pancreatic cancers than in the normal tissues on this panel. This suggests that expression of the gene product could potentially be used as a diagnostic marker for cancers of these tissues. Thus, therapeutic inhibition of the expression or function of this gene, through the use of antibodies, small molecule or protein drugs, may be effective in the treatment of these cancers.

This gene is moderately expressed in a variety of metabolic tissues including pancreas, adrenal, thyroid, pituitary, adult and fetal liver, and adipose. Thus, this gene product may be important in the pathogenesis, diagnosis, and/or treatment of metabolic disease in any or all of these tissues, including obesity and diabetes.

This gene, a P450 homolog, is expressed at low levels in the CNS. Some isoforms of P450 have been shown to be present in the brain and have even been implicated in Alzheimer's disease. Therefore, the protein encoded by this gene may be important in the pathogenesis, diagnosis, and/or treatment of brain diseases, including Alzheimer's disease.

Despite the very small amounts of cytochrome P450 (P450, CYP) enzymes expressed in different areas and cell populations of the brain as compared with the liver, there is significant evidence for their specific involvement in brain development, function and plasticity. Nevertheless, the current discussion about occurrence and importance of cerebral cytochrome P450s is determined by inconsistent interpretations of their function in general and with respect to single isoforms. Recent evidence shows the constitutive expression of CYP2B1 and CYP2B2 mRNAs in rat brain. Immunocytochemical and non-radioactive in situ hybridization studies revealed the same expression pattern throughout the brain predominantly in neuronal populations, but to some extent in astrocytes of corpus callosum and olfactory bulb. The well known testosterone-metabolizing capacity and the presence of CYP2B isoforms shown in steroid hormone-sensitive areas and neurones (e.g. hippocampus) clarify the significance of isoforms like CYP2B1 and CYP2B2 for impairment of steroid hormone actions by P450 inducing environmental substances. See Rosenbrock, H., et al., PMID: 11208896.

Data suggests that the Alzheimer's amyloid peptide (Abeta) causes degeneration and death of neurons by mechanisms that involve reactive oxygen species. The pathways involved in Abeta-mediated oxidative injury are only partially understood. A recent study showed that following exposure to Abeta peptides, neuroblastoma cells showed a clear-cut induction of CP450r. Furthermore, tissue sections from brains of transgenic mice exhibited strong immunoreactivity for CP450r, surrounding amyloid deposits. The pattern of expression of CP450r was similar to that exhibited by neuritic and oxidative stress markers. Sections from non-transgenic mice showed no detectable immunoreactivity. Immunostaining of sections from four brains with neuropathologically confirmed AD showed a pattern of abnormality different from transgenic mice that was characterized by abnormal immunoreactivity for CP450r within the cytoplasm of cortical neurons. No labeling was seen in sections from age-matched control brains. Thus, CP450r is induced by Alzheimer amyloid peptide and such a response must be considered as one possible mechanism whereby Abeta causes oxidative stress. See Pappolla, M. A., PMID: 11432979.

Panel 4D Summary: Ag3389 This gene encodes a cytochrome P450-like protein and is expressed at moderate levels across numerous immune cell types and tissues, with highest expression in bronchial epithelium stimulated with TNFalpha+IL1beta (CT=27.43), untreated small airway epithelium (CT=28.27), and small airway epithelium stimulated with TNFalpha+IL-1beta (CT=26.89). This expression profile suggests that small molecule antagonists of this gene product may be useful as therapeutics that reduce or eliminate symptoms caused by inflammation in lung epithelia due to chronic obstructive pulmonary disease, asthma, allergy, and emphysema.

The cytochromes P450 have a central role in the oxidative activation and detoxification of a wide range of xenobiotics, including many carcinogens and several anti-cancer drugs. Thus the cytochrome P450 enzyme system plays important roles in both tumour development and influencing the response of tumours to chemotherapy. Stomach cancer is one of the most common tumours of the alimentary tract and environmental factors, including dietary factors, have been implicated in the development of this tumour. This type of tumour has a poor prognosis and responds poorly to current therapies. Recently, the presence and cellular localization of several major forms of P450, CYP1A, CYP2E1 and CYP3A have been investigated in stomach cancer and compared with their expression in normal stomach. There was enhanced expression of CYP1A and CYP3A in stomach cancer with CYP1A present in 51% and CYP3A present in 28% of cases. In contrast, no P450 was identified in normal stomach. The presence of CYP1A and CYP3A in stomach cancer provides further evidence for the enhanced expression of specific forms of cytochrome P450 in tumours and may be important therapeutically for the development of anti-cancer drugs that are activated by these forms of P450. See Murray, G. I., et al., *Br J Cancer*, 1998 April; 77(7):1040–4. PMID: 9569036

N. NOV15

CG50163-01/sggc_draft_ba294a4_20009808 and CG50163-02: Nucleoside Phosphatase

Expression of gene CG50163-01 and variant CG50163-02 was assessed using the primer-probe set Ag2376, described in Table NA. Results of the RTQ-PCR runs are shown in Tables NB, NC, ND, NE and NF.

TABLE NA

Probe Name Ag2376

| Primers | Sequences | Length | Start Position | SEQ ID NO |
|---|---|---|---|---|
| Forward | 5'-tgggtatgaatgtgtgagttca-3' | 22 | 2085 | 217 |
| Probe | TET-5'-agaggcctgctctcctcacacattgt-3'-TAMRA | 26 | 2110 | 218 |
| Reverse | 5'-gtgtctccctccatcattaacc-3' | 22 | 2145 | 219 |

TABLE NB

CNS_neurodegeneration_v1.0

| Tissue Name | Rel. Exp. (%) Ag2376, Run 208271228 | Tissue Name | Rel. Exp. (%) Ag2376, Run 208271228 |
|---|---|---|---|
| AD 1 Hippo | 13.7 | Control (Path) 3 Temporal Ctx | 3.5 |
| AD 2 Hippo | 35.1 | Control (Path) 4 Temporal Ctx | 22.4 |
| AD 3 Hippo | 6.3 | AD 1 Occipital Ctx | 12.1 |
| AD 4 Hippo | 8.0 | AD 2 Occipital Ctx (Missing) | 0.0 |
| AD 5 Hippo | 72.7 | AD 3 Occipital Ctx | 4.7 |
| AD 6 Hippo | 33.4 | AD 4 Occipital Ctx | 13.9 |
| Control 2 Hippo | 30.1 | AD 5 Occipital Ctx | 87.1 |
| Control 4 Hippo | 7.1 | AD 5 Occipital Ctx | 22.5 |
| Control (Path) 3 Hippo | 3.6 | Control 1 Occipital Ctx | 3.1 |
| AD 1 Temporal Ctx | 8.3 | Control 2 Occipital Ctx | 55.1 |
| AD 2 Temporal Ctx | 31.6 | Control 3 Occipital Ctx | 12.0 |
| AD 3 Temporal Ctx | 8.4 | Control 4 Occipital Ctx | 5.8 |
| AD 4 Temporal Ctx | 17.1 | Control (Path) 1 Occipital Ctx | 73.7 |
| AD 5 Inf Temporal Ctx | 76.3 | Control (Path) 2 Occipital Ctx | 7.5 |
| AD 5 Sup Temporal Ctx | 36.3 | Control (Path) 3 Occipital Ctx | 3.0 |
| AD 6 Inf Temporal Ctx | 51.8 | Control (Path) 4 Occipital Ctx | 15.7 |
| AD 6 Sup Temporal Ctx | 41.5 | Control 1 Parietal Ctx | 5.3 |
| Control 1 Temporal Ctx | 7.1 | Control 2 Parietal Ctx | 25.9 |
| Control 2 Temporal Ctx | 46.7 | Control 3 Parietal Ctx | 12.6 |
| Control 3 Temporal Ctx | 14.6 | Control (Path) 1 Parietal Ctx | 100.0 |
| Control 3 Temporal Ctx | 9.0 | Control (Path) 2 Parietal Ctx | 22.4 |
| Control (Path) 1 Temporal Ctx | 54.0 | Control (Path) 3 Parietal Ctx | 3.8 |
| Control (path) 1 Temporal Ctx | 25.3 | Control (Path) 4 Parietal Ctx | 45.1 |

TABLE NC

Panel 1.3D

| Tissue Name | Rel. Exp. (%) Ag2376, Run 165631672 | Tissue Name | Rel. Exp. (%) Ag2376, Run 165631672 |
|---|---|---|---|
| Liver adenocarcinoma | 5.4 | Kidney (fetal) | 6.7 |
| Pancreas | 8.0 | Renal ca. 786-0 | 2.7 |
| Pancreatic ca. CAPAN 2 | 4.5 | Renal ca. A498 | 16.0 |
| Adrenal gland | 14.7 | Renal ca. RXF 393 | 6.3 |
| Thyroid | 6.0 | Renal ca. ACHN | 3.5 |
| Salivary gland | 14.4 | Renal ca. UO-31 | 5.5 |
| Pituitary gland | 13.5 | Renal ca. TK-10 | 2.5 |
| Brain (fetal) | 20.0 | Liver | 6.7 |
| Brain (whole) | 56.3 | Liver (fetal) | 6.8 |
| Brain (amygdala) | 66.0 | Liver ca. (hepatoblast) HepG2 | 28.9 |
| Brain (cerebellum) | 34.9 | Lung | 10.1 |
| Brain (hippocampus) | 100.0 | Lung (fetal) | 3.5 |

TABLE NC-continued

Panel 1.3D

| Tissue Name | Rel. Exp. (%) Ag2376, Run 165631672 | Tissue Name | Rel. Exp. (%) Ag2376, Run 165631672 |
|---|---|---|---|
| Brain (substantia nigra) | 23.7 | Lung ca. (small cell) LX-1 | 4.8 |
| Brain (thalamus) | 44.4 | Lung ca. (small cell) NCI-H69 | 2.9 |
| Cerebral Cortex | 40.3 | Lung ca. (s.cell var.) SHP-77 | 6.6 |
| Spinal cord | 17.2 | Lung ca. (large cell)NCI-H460 | 21.8 |
| glio/astro U87-MG | 6.4 | Lung ca. (non-sm. cell) A549 | 7.5 |
| glio/astro U-118-MG | 25.2 | Lung ca. (non-s.cell) NCI-H23 | 6.1 |
| astrocytoma SW1783 | 10.7 | Lung ca. (non-s.cell) HOP-62 | 8.1 |
| neuro*; met SK-N-AS | 5.3 | Lung ca. (non-s.cl) NCI-H522 | 1.9 |
| astrocytoma SF-539 | 10.3 | Lung ca. (squam.) SW 900 | 4.4 |
| astrocytoma SNB-75 | 14.2 | Lung ca. (squam.) NCI-H596 | 2.4 |
| glioma SNB-19 | 9.0 | Mammary gland | 14.7 |
| glioma U251 | 18.3 | Breast ca.* (pl.ef) MCF-7 | 6.1 |
| glioma SF-295 | 4.4 | Breast ca.* (pl.ef) MDA-MB-231 | 19.5 |
| Heart (Fetal) | 8.9 | Breast ca.* (pl.ef) T47D | 7.3 |
| Heart | 19.1 | Breast ca. BT-549 | 22.2 |
| Skeletal muscle (Fetal) | 1.4 | Breast ca. MDA-N | 7.2 |
| Skeletal muscle | 11.8 | Ovary | 3.4 |
| Bone marrow | 3.6 | Ovarian ca. OVCAR-3 | 7.1 |
| Thymus | 17.3 | Ovarian ca. OVCAR-4 | 3.5 |
| Spleen | 7.0 | Ovarian ca. OVCAR-5 | 8.0 |
| Lymph node | 15.5 | Ovarian ca. OVCAR-8 | 3.6 |
| Colorectal | 8.2 | Ovarian ca. IGROV-1 | 6.0 |
| Stomach | 20.3 | Ovarian ca. (ascites) SK-OV-3 | 7.5 |
| Small intestine | 49.0 | Uterus | 15.5 |
| Colon ca. SW480 | 7.2 | Placenta | 5.1 |
| Colon ca.* SW620 (SW480 met) | 3.6 | Prostate | 33.4 |
| Colon ca. HT29 | 8.4 | Prostate ca.* (bone met) PC-3 | 7.7 |
| Colon ca. HCT-116 | 2.9 | Testis | 11.4 |
| Colon ca. CaCo-2 | 5.9 | Melanoma Hs688(A).T | 2.1 |
| CC Well to Mod Diff (ODO3866) | 17.3 | Melanoma* (met) Hs688(B).T | 1.9 |
| Colon ca. HCC-2998 | 5.8 | Melanoma UACC-62 | 7.4 |
| Gastric ca. (liver met) NCI-N87 | 25.7 | Melanoma M14 | 33.9 |
| Bladder | 2.0 | Melanoma LOX IMVI | 2.0 |
| Trachea | 15.8 | Melanoma* (met) SK-MEL-5 | 6.0 |
| Kidney | 7.4 | Adipose | 3.5 |

TABLE ND

Panel 2.2

| Tissue Name | Rel. Exp. (%) Ag2376, Run 174553775 | Tissue Name | Rel. Exp. (%) Ag2376, Run 174553775 |
|---|---|---|---|
| Normal Colon | 52.5 | Kidney Margin (OD04348) | 94.6 |
| Colon cancer (OD06064) | 60.3 | Kidney malignant cancer (OD06204B) | 22.1 |
| Colon Margin (OD06064) | 58.6 | Kidney normal adjacent tissue (OD06204E) | 17.7 |
| Colon cancer (OD06159) | 27.5 | Kidney Cancer (OD04450-01) | 72.2 |
| Colon Margin (OD06159) | 29.9 | Kidney Margin (OD04450-03) | 24.0 |
| Colon cancer (OD06297-04) | 39.2 | Kidney Cancer 8120613 | 27.0 |
| Colon Margin (OD06297-015) | 62.0 | Kidney Margin 8120614 | 52.5 |
| CC Gr.2 ascend colon (ODO3921) | 76.8 | Kidney Cancer 9010320 | 26.2 |
| CC Margin (ODO3921) | 38.4 | Kidney Margin 9010321 | 18.8 |
| Colon cancer metastasis (OD06104) | 34.4 | Kidney Cancer 8120607 | 77.4 |
| Lung Margin (OD06104) | 35.8 | Kidney Margin 8120608 | 41.2 |
| Colon mets to lung (OD04451-01) | 100.0 | Normal Uterus | 21.3 |
| Lung Margin (OD04451-02) | 16.2 | Uterine Cancer 064011 | 18.4 |
| Normal Prostate | 62.9 | Normal Thyroid | 8.3 |
| Prostate Cancer (OD04410) | 31.6 | Thyroid Cancer | 11.5 |
| Prostate Margin (OD04410) | 29.5 | Thyroid Cancer A302152 | 19.8 |

TABLE ND-continued

Panel 2.2

| Tissue Name | Rel. Exp. (%) Ag2376, Run 174553775 | Tissue Name | Rel. Exp. (%) Ag2376, Run 174553775 |
|---|---|---|---|
| Normal Ovary | 33.9 | Thyroid Margin A302153 | 4.1 |
| Ovarian cancer (OD06283-03) | 40.9 | Normal Breast | 29.7 |
| Ovarian Margin (OD06283-07) | 5.9 | Breast Cancer | 22.4 |
| Ovarian Cancer | 20.0 | Breast Cancer | 62.9 |
| Ovarian cancer (OD06145) | 11.0 | Breast Cancer (OD04590-01) | 50.0 |
| Ovarian Margin (OD06145) | 32.1 | Breast Cancer Mets (OD04590-03) | 42.3 |
| Ovarian cancer (OD06455-03) | 22.8 | Breast Cancer Metastasis | 77.4 |
| Ovarian Margin (OD06455-07) | 7.4 | Breast Cancer | 27.9 |
| Normal Lung | 20.6 | Breast Cancer 9100266 | 20.0 |
| Invasive poor diff. lung adeno (ODO4945-01 | 28.7 | Breast Margin 9100265 | 13.6 |
| Lung Margin (ODO4945-03) | 10.3 | Breast Cancer A209073 | 8.2 |
| Lung Malignant Cancer (OD03126) | 33.7 | Breast Margin A2090734 | 40.6 |
| Lung Margin (OD03126) | 19.2 | Breast cancer (OD06083) | 15.8 |
| Lung Cancer (OD05014A) | 39.0 | Breast cancer node metastasis (OD06083) | 18.2 |
| Lung Margin (OD05014B) | 20.3 | Normal Liver | 25.7 |
| Lung cancer (OD06081) | 20.2 | Liver Cancer 1026 | 51.1 |
| Lung Margin (OD06081) | 9.3 | Liver Cancer 1025 | 46.0 |
| Lung Cancer (OD04237-01) | 25.5 | Liver Cancer 6004-T | 36.3 |
| Lung Margin (OD04237-02) | 24.5 | Liver Tissue 6004-N | 18.6 |
| Ocular Mel Met to Liver (ODO4310) | 75.8 | Liver Cancer 6005-T | 88.3 |
| Liver Margin (ODO4310) | 16.4 | Liver Tissue 6005-N | 59.0 |
| Melanoma Metastasis | 65.1 | Liver Cancer | 14.4 |
| Lung Margin (OD04321) | 12.0 | Normal Bladder | 27.7 |
| Normal Kidney | 13.7 | Bladder Cancer | 28.5 |
| Kidney Ca, Nuclear grade 2 (OD04338) | 47.0 | Bladder Cancer | 28.9 |
| Kidney Margin (OD04338) | 11.3 | Normal Stomach | 61.6 |
| Kidney Ca Nuclear grade 1/2 (OD04339) | 37.1 | Gastric Cancer 9060397 | 68.8 |
| Kidney Margin (OD04339) | 16.0 | Stomach Margin 9060396 | 37.6 |
| Kidney Ca, Clear cell type (OD04340) | 13.6 | Gastric Cancer 9060395 | 25.2 |
| Kidney Margin (OD04340) | 24.5 | Stomach Margin 9060394 | 49.3 |
| Kidney Ca, Nuclear grade 3 (OD04348) | 23.8 | Gastric Cancer 064005 | 42.6 |

TABLE NE

Panel 4D

| Tissue Name | Rel. Exp. (%) Ag2376, Run 164216613 | Tissue Name | Rel. Exp. (%) Ag2376, Run 164216613 |
|---|---|---|---|
| Secondary Th1 act | 49.0 | HUVEC IL-1beta | 17.2 |
| Secondary Th2 act | 32.1 | HUVEC IFN gamma | 35.6 |
| Secondary Tr1 act | 34.9 | HUVEC TNF alpha + IFN gamma | 50.0 |
| Secondary Th1 rest | 7.9 | HUVEC TNF alpha + IL4 | 39.2 |
| Secondary Th2 rest | 17.3 | HUVEC IL-11 | 31.0 |
| Secondary Tr1 rest | 14.9 | Lung Microvascular EC none | 94.6 |
| Primary Th1 act | 37.6 | Lung Microvascular EC TNF alpha + IL-1beta | 35.6 |
| Primary Th2 act | 38.7 | Microvascular Dermal EC none | 67.8 |
| Primary Tr1 act | 45.7 | Microsvascular Dermal EC TNF alpha + IL-1beta | 36.6 |
| Primary Th1 rest | 61.6 | Bronchial epithelium TNF alpha + IL1beta | 99.3 |
| Primary Th2 rest | 28.3 | Small airway epithelium none | 22.2 |

TABLE NE-continued

Panel 4D

| Tissue Name | Rel. Exp. (%) Ag2376, Run 164216613 | Tissue Name | Rel. Exp. (%) Ag2376, Run 164216613 |
|---|---|---|---|
| Primary Tr1 rest | 24.3 | Small airway epithelium TNF alpha + IL-1beta | 61.1 |
| CD45RA CD4 lymphocyte act | 30.1 | Coronery artery SMC rest | 44.4 |
| CD45RO CD4 lymphocyte act | 29.3 | Coronery artery SMC TNF alpha + IL-1beta | 17.8 |
| CD8 lymphocyte act | 33.7 | Astrocytes rest | 36.9 |
| Secondary CD8 lymphocyte rest | 38.4 | Astrocytes TNF alpha + IL-1beta | 25.0 |
| Secondary CD8 lymphocyte act | 12.4 | KU-812 (Basophil) rest | 28.7 |
| CD4 lymphocyte none | 22.5 | KU-812 (Basophil) PMA/ionomycin | 57.8 |
| 2ry Th1/Th2/Tr1_anti-CD95 CH11 | 15.7 | CCD1106 (Keratinocytes) none | 84.7 |
| LAK cells rest | 33.7 | CCD1106 (Keratinocytes) TNF alpha + IL-1beta | 73.2 |
| LAK cells IL-2 | 29.7 | Liver cirrhosis | 15.4 |
| LAK cells IL-2 + IL-12 | 37.4 | Lupus kidney | 6.4 |
| LAK cells IL-2 + IFN gamma | 30.8 | NCI-H292 none | 31.4 |
| LAK cells IL-2 + IL-18 | 32.5 | NCI-H292 IL-4 | 37.4 |
| LAK cells PMA/ionomycin | 7.4 | NCI-H292 IL-9 | 52.1 |
| NK Cells IL-2 rest | 18.2 | NCI-H292 IL-13 | 23.2 |
| Two Way MLR 3 day | 33.4 | NCI-H292 IFN gamma | 35.4 |
| Two Way MLR 5 day | 28.5 | HPAEC none | 36.6 |
| Two Way MLR 7 day | 17.3 | HPAEC TNF alpha + IL-1 beta | 62.4 |
| PBMC rest | 16.8 | Lung fibroblast none | 55.1 |
| PBMC PWM | 81.8 | Lung fibroblast TNF alpha + IL-1beta | 26.8 |
| PBMC PHA-L | 38.7 | Lung fibroblast IL-4 | 85.3 |
| Ramos (B cell) none | 50.7 | Lung fibroblast IL-9 | 73.2 |
| Ramos (B cell) ionomycin | 88.3 | Lung fibroblast IL-13 | 0.5 |
| B lymphocytes PWM | 67.4 | Lung fibroblast IFN gamma | 82.4 |
| B lymphocytes CD40L and IL-4 | 19.8 | Dermal fibroblast CCD1070 rest | 75.8 |
| EOL-1 dbcAMP | 17.3 | Dermal fibroblast CCD1070 TNF alpha | 77.4 |
| EOL-1 dbcAMP PMA/ionomycin | 23.8 | Dermal fibroblast CCD1070 IL-1beta | 34.2 |
| Dendritic cells none | 52.5 | Dermal fibroblast IFN gamma | 42.3 |
| Dendritic cells LPS | 18.3 | Dermal fibroblast IL-4 | 64.6 |
| Dendritic cells anti-CD40 | 55.1 | IBD Colitis 2 | 3.1 |
| Monycytes rest | 49.7 | IBD Crohn's | 6.2 |
| Monocytes LPS | 16.2 | Colon | 55.5 |
| Macrophages rest | 41.2 | Lung | 26.6 |
| Macrophages LPS | 21.8 | Thymus | 50.0 |
| HUVEC none | 54.3 | Kidney | 100.0 |
| HUVEC starved | 64.2 | | |

TABLE NF

Panel CNS_1

| Tissue Name | Rel. Exp. (%) Ag2376, Run 171656284 | Tissue Name | Rel. Exp. (%) Ag2376, Run 171656284 |
|---|---|---|---|
| BA4 Control | 42.9 | BA17 PSP | 31.9 |
| BA4 Control2 | 60.7 | BAI7 PSP2 | 16.2 |
| BA4 Alzheimer's2 | 4.9 | Sub Nigra Control | 18.8 |
| BA4 Parkinson's | 46.7 | Sub Nigra Control2 | 24.1 |
| BA4 Parkinson's2 | 75.8 | Sub Nigra Alzheimer's2 | 10.3 |
| BA4 Huntington's | 38.4 | Sub Nigra Parkinson's2 | 35.6 |
| BA4 Huntingson's2 | 12.5 | Sub Nigra Huntington's | 52.9 |
| BA4 PSP | 5.8 | Sub Nigra Huntington's2 | 20.3 |
| BA4 PSP2 | 29.5 | Sub Nigra PSP2 | 2.6 |
| BA4 Depression | 12.0 | Sub Nigra Depression | 7.7 |
| BA4 Depression2 | 4.8 | Sub Nigra Depression2 | 4.7 |
| BA7 Control | 65.5 | Glob Palladus Control | 11.3 |

TABLE NF-continued

Panel CNS_1

| Tissue Name | Rel. Exp. (%) Ag2376, Run 171656284 | Tissue Name | Rel. Exp. (%) Ag2376, Run 171656284 |
|---|---|---|---|
| BA7 Control2 | 40.6 | Glob Palladus Control2 | 21.2 |
| BA7 Alzheimer's2 | 8.2 | Glob Palladus Alzheimer's | 4.8 |
| BA7 Parkinson's | 12.9 | Glob Palladus Alzheimer's2 | 3.2 |
| BA7 Parkinson's2 | 45.1 | Glob Palladus Parkinson's | 79.6 |
| BA7 Huntington's | 38.7 | Glob Palladus Parkinson's2 | 11.7 |
| BA7 Huntington's2 | 29.3 | Glob Palladus PSP | 7.9 |
| BA7 PSP | 49.3 | Glob Palladus PSP2 | 9.5 |
| BA7 PSP2 | 33.4 | Glob Palladus Depression | 5.1 |
| BA7 Depression | 8.8 | Temp Pole Control | 25.5 |
| BA9 Control | 27.5 | Temp Pole Control2 | 64.2 |
| BA9 Control2 | 100.0 | Temp Pole Alzheimer's | 4.9 |
| BA9 Alzheimer's | 6.0 | Temp Pole Alzheimer's2 | 6.2 |
| BA9 Alzheimer's2 | 16.5 | Temp Pole Parkinson's | 22.4 |
| BA9 Parkinson's | 23.0 | Temp Pole Parkinson's2 | 34.9 |
| BA9 Parkinson's2 | 58.6 | Temp Pole Huntington's | 71.2 |
| BA9 Huntington's | 68.8 | Temp Pole PSP | 4.6 |
| BA9 Huntington's2 | 9.7 | Temp Pole PSP2 | 9.0 |
| BA9 PSP | 22.5 | Temp Pole Depression2 | 6.4 |
| BA9 PSP2 | 9.2 | Cing Gyr Control | 71.7 |
| BA9 Depression | 9.7 | Cing Gyr Control2 | 45.1 |
| BA9 Depression2 | 7.4 | Cing Gyr Alzheimer's | 19.3 |
| BA17 Control | 32.3 | Cing Gyr Alzheimer's2 | 6.0 |
| BA17 Control2 | 56.6 | Cing Gyr Parkinson's | 17.1 |
| BA17 Alzheimer's2 | 3.7 | Cing Gyr Parkinson's2 | 37.1 |
| BA17 Parkinson's | 29.9 | Cing Gyr Huntington's | 74.2 |
| BA17 Parkinson's2 | 46.7 | Cing Gyr Huntington's2 | 12.9 |
| BA17 Huntington's | 40.3 | Cing Gyr PSP | 12.3 |
| BA17 Huntington's2 | 24.0 | Cing Gyr PSP2 | 4.4 |
| BA17 Depression | 5.1 | Cing Gyr Depression | 5.4 |
| BA17 Depression2 | 17.9 | Cing Gyr Depression2 | 13.9 |

CNS_neurodegeneration_v1.0 Summary: Ag2376 Panel CNS_Neurodegeneration does reflect any difference in the expression of this gene between the postmortem brains of controls or Alzheimer's disease patients. This panel does, however, confirm the expression of this gene at moderate to high levels in the brains of an independent group of patients. See panel 1.3d for discussion of utility in the central nervous system.

Panel 1.3D Summary: Ag2376 This gene shows a brain—preferential expression pattern, and is expressed at moderate levels in all CNS regions examined, with highest expression in the hippocampus (CT=28.5). This gene encodes a nucleoside phosphatase homolog of CD39L2, which is believed to be involved in the extracellular hydrolysis of free nucleotides. Therefore, targeting of this molecule would be an indirect way to influence the activation of purinergic and adenosine receptors in the brain, which have been implicated in stroke, sleep/insomnia, and parkinsonian-like muscle rigidity. Thus, therapeutic modulation of this gene or its protein product may be of benefit in the treatment of any of these disorders.

This gene is expressed at low but significant levels in all the cancer cell lines in this panel. This ubiquitous expression suggests it plays a role in cell survival and proliferation for a majority of cell types.

This gene is also moderately expressed in a wide variety of metabolic tissues including pancreas, adrenal, thyroid, pituitary, adult and fetal heart, skeletal muscle, adult and fetal liver, and adipose. Thus, this gene product may be a small molecule drug target for the treatment of metabolic diseases, including obesity and Types 1 and 2 diabetes. Furthermore, the significant levels of expression in the heart of this CD39L2 homolog support a functional role for this protein in regulating platelet activation and recruitment in the heart.

The rat-brain-derived cDNA encoding nucleoside triphosphate diphosphohydrolase 6 (NTPDase6), a novel member of the ecto-nucleoside triphosphate diphosphohydrolase family, has an open reading frame of 1365 bp encoding a protein of 455 amino acid residues, with a calculated molecular mass of 49971 Da and a predicted N-terminal hydrophobic sequence. It shares 86% sequence identity with the human CD39L2 sequence and 48% and 51% identity respectively with sequences of the two related human and murine nucleoside diphosphatases (CD39L4, NTPDase5/ER-UDPase). The mRNA was expressed in all tissues investigated, revealing two major transcripts with differing abundances. PCR analysis suggests a single open reading frame. A Myc-His-tagged NTPDase6 was expressed in Chinese hamster ovary (CHO) and PC12 cells for immunological analysis and protein isolation. The protein was contained in membrane fractions of transfected CHO cells and occurred in a soluble form in the cell culture supernatants. NTPDase6 preferentially hydrolysed nucleoside 5'-diphosphates. With different substrates the order of activity was GDP>IDP>>UDP, CDP>>ADP. Nucleoside 5'-triphosphates were hydrolysed only to a minor extent and no hydrolysis of nucleoside 5'-monophosphates was observed. The enzyme was strongly and equally activated by Ca(2+) and Mg(2+) and had a K(m) for GDP of 211 microM. The immunohistochemical analysis of transfected CHO and PC12 cells suggests that NTPDase6 is associated with the Golgi apparatus and to a small extent also with the plasma membrane. The enzyme might support glycosylation reactions in the Golgi apparatus and, when released from cells, might catalyse the hydrolysis of extracellular nucleotides. See Braun, N., et al., *Biochem J*, 2000 Nov. 1; 351 Pt 3:639–47.

The involvement of adenosine A3 receptors in normal and pathologic functions of the brain remains to be defined.

Previous studies have shown that chronic preischemic administration of the agonist [N6-(3-iodobenzyl)-5'-N-methylcarboxoamidoadenosine or IB-MECA) results in a significant protection of neurons in selectively vulnerable brain regions and in an equally significant reduction of the subsequent mortality. Acute administration of the drug, on the other hand, resulted in a pronounced worsening of these parameters. Recently it was shown that the effect of administration of IB-MECA depends on the timing of treatment with respect to the onset of the focal insult. Thus, treatment with adenosine A3 receptor agonists may decrease the infarct size following focal brain ischemia. Treatment with IB-MECA administered 20 min prior to transient middle cerebral ischemia (MCAOt=30 min) resulted in a significant increase of the infarct size (p<0.01), whereas administration 20 min after ischemia resulted in statistically significant decrease of the infarct volume. Postischemic treatment results in improved neuronal preservation, decreased intensity of reactive gliosis, and pronounced reduction of microglial infiltration. The data indicate that the effects of adenosine A3 receptor stimulation depend on the differential impact of these receptors on both neuronal and non-neuronal elements of the cerebral tissue, for example, astrocytes, microglia, and vasculature. See Von Lubitz, D. K., et al., *Ann N Y Acad Sci,* 2001 June; 939:85–96.

A recent study examined whether blockade of adenosine A(2A) receptors by a selective antagonist, SCH 58261, influenced Parkinsonian-like muscle rigidity. Muscle tone was examined using a combined mechano- and electromyographic method which simultaneously measured muscle resistance (MMG) of a rat hindfoot to passive extension and flexion in the ankle joint and electromyographic activity (EMG) of the antagonistic muscles of that joint: gastrocnemius and tibialis anterior. Muscle rigidity produced by reserpine (5 mg/kg+alpha-methyl-p-tyrosine, 250 mg/kg) was antagonized by SCH 58261 (0.1–5 mg/kg). SCH 58261 (5 mg/kg) also reduced reserpine-enhanced tonic and reflex EMG activities in both the gastrocnemius and the tibialis muscles. Moreover, SCH 58261 in doses of 1 and 5 mg/kg abolished muscle resistance induced by haloperidol (0.5 mg/kg). However, only the highest dose of SCH 58261 (5 mg/kg) decreased tonic EMG activity enhanced by haloperidol. Administration of L-DOPA (75 and 100 mg/kg) dose-dependently decreased the muscle resistance as well as tonic EMG activity evoked by haloperidol. Combined administration of SCH 58261 (0.1 mg/kg) and L-DOPA (50 mg/kg) in doses which did not affect the haloperidol-induced muscle rigidity produced a pronounced synergistic effect. The ability of SCH 58261 to diminish the parkinsonian-like muscle rigidity and to potentiate the effect of L-DOPA in this model indicates a therapeutic value of this compound in the treatment of Parkinson's disease. See Wardas, J., et al., *Synapse,* 2001 August; 41(2): 160–71.

It is well established that uridine is one of the sleep-promoting substances. New types of hypnotic compounds were synthesized from oxopyrimidine nucleosides. Their mechanism of action in CNS depressant effects is elucidated based on the receptor theory. Recently, structure-activity relationship for CNS depressant properties, sleep-promoting effects, interaction with certain CNS receptors, and receptor binding assay of uridine derivatives as oxopyrimidine nucleoside were investigated. In the studies of structure-activity relationship of N3-substituted uridine, it was found that both N3-benzyluridine and N3-phenacyluridine synthesized exhibited potent hypnotic activity (loss of righting reflex) by intracerebroventicular injection in mice. Moreover, certain derivatives of these compounds possessed synergistic effects with barbiturate and benzodiazepine, and decreased in spontaneous activity, motor incoordination, and antianxiety effects in mice. Especially, N3-phenacyluridine markedly enhanced pentobarbital- and diazepam-induced sleep by 6- and 70-fold, respectively. However, N3-benzyluracil and N3-phenacyluracil that have no ribose moiety did not possess any hypnotic activity, indicating specific effects of nucleoside derivatives. Effects of N3-benzyluridine on natural sleep in rats were thus examined. N3-Benzyluridine also possessed the sleep promoting effect assessed by electrocorticogram at the dose of 10 pmol. To elucidate the mechanism of action of N3-phenacyluridine, the interactions of this compound with benzodiazepine, GABA, 5-HT, or adenosine receptors were also investigated. Although the pharmacological activity of N3-phenacyluridine was high, the affinities to benzodiazepine, GABA, 5-HT, and adenosine receptors were quite low. [3H]N3-Phenacyluridine concentration-dependently bound to synaptic membrane prepared from the bovine brain. The Scatchard analysis revealed a single component of the binding site. This binding site is most likely a novel receptor, "uridine receptor", for hypnotic activity of the uridine derivatives. The rank order of the distribution of these specific binding sites was found to be striatum>thalamus>cerebral cortex>cerebellum>mid brain>medulla oblongata in the rat brain. N3-phenacyluridine was exclusively metabolized to N3-(S)-(+)-alpha-hydroxy-beta-phenethyluridine, but not the (R)-form, in mice. N3-(S)-(+)-alpha-Hydroxy-beta-phenylethyluridine possessed not only strong hypnotic activity but also a high affinity to the uridine receptor of synaptic membranes, while the (R)-isomer was low in both activities. Racemic mixture was shown to be intermediate for pharmacological effects of the compounds. These studies which used (R)- or (S)-isomer indicate that uridine binding site or uridine receptor, exists in the CNS and plays some role in sleep regulation in mammals as one of the triggering steps in inducing hypnotic activity. It is suggested that uridine is released from steps of nucleic acid-nucleic protein biosynthesis (catabolism), and reaches the binding sites in the areas of the brain which regulate natural sleep. The uridine dissociated from the receptor is then utilized for the synthesis of nucleic acid (anabolism). Therefore, the induction of sleep may be mediated by uridine through uridine receptor in the CNS, although the structure of uridine receptor is not yet elucidated. See Kimura, T., et al., *Sleep,* 2000 May 1; 24(3):251–60.

E-NTPDases are extracellular enzymes that hydrolyze nucleotides. The human E-NTPDase gene family currently consists of five reported members (CD39, CD39L1, CD39L2, CD39L3, and CD39L4). Both membrane-bound and secreted family members have been predicted by encoded transmembrane and leader peptide motifs. Recently it was shown that the human CD39L2 gene is expressed predominantly in the heart. In situ hybridization results from heart indicate that the CD39L2 message is expressed in muscle and capillary endothelial cells. This CD39L2 gene encodes an extracellular E-NTPDase. Flow cytometric experiments show that transiently expressed CD39L2 is present on the surface of COS-7 cells. Transfected cells also produce recombinant glycosylated protein in the medium, and this process can be blocked by brefeldin A, an inhibitor of the mammalian secretory pathway. The enzymology of CD39L2 shows characteristic features of a typical E-NTPDase, but with a much higher degree of specificity for NDPs over NTPs as enzymatic substrates. The kinetics of the ADPase activity exhibit positive cooperativity. The predominance of CD39L2 expression in the heart supports a functional role in regulating platelet activation and recruitment in this organ. See Yeung, G., et al., *Biochemistry*, 2000 Oct. 24; 39(42):12916–23. PMID: 11041856

Panel 2.2 Summary: Ag2376 The highest level of expression in this panel is seen in a sample derived from a colon cancer metastasis to lung (CT=30.8). Comparatively higher levels of expression are seen in colon, liver, thyroid, lung, 2 of 3 ovarian cancers, 6 of 9 kidney cancers, a sample of melanoma metastasis to lung and a sample of ocular melanoma metastasis to liver compared to the normal adjacent tissues from these samples. Thus, expression of this gene can be used as a diagnostic marker of these cancer and therapeutic inhibition of the gene could potentially be used for treatment of these cancers.

Panel 4D Summary: This protein encodes a nucleoside phosphatase-like protein and is expressed at moderate levels (CT=29–33) in numerous immune cell types and tissues. Therefore, small molecule antagonists that block the function of this gene product may be useful as therapeutics that reduce or eliminate the symptoms of patients suffering from autoimmune and inflammatory diseases such as asthma, allergies, inflammatory bowel disease, lupus erythematosus, or rheumatoid arthritis.

Panel CNS_1 Summary: Ag2376 Panel CNS_1 does not reflectt any difference in the expression of this gene between the postmortem brains of control and diseased patients. This panel does, however, confirm the expression of this gene at moderate levels in the brains of an independent group of patients. See panel 1.3d for discussion of utility in the central nervous system.

O. NOV19

CG50157-01/MBNM$_{13}$ 004056_da2 and CG50157-02: Carbonic Anhydrase Related Protein Expression of gene CG50157-01 and variant CG50157-02 was assessed using the primer-probe set Ag1755, described in Table OA. Results of the RTQ-PCR runs are shown in Tables OB, OC, OD, OE and OF.

TABLE OA

Probe Name Ag1755

| Primers | Sequences | Length | Start Position | SEQ ID NO |
|---|---|---|---|---|
| Forward | 5'-aagggaagtccaaaacaatac-3' | 22 | 478 | 220 |
| Probe | TET-5'-ctttattaccagaccctctgctgcgg-3'-TAMRA | 26 | 518 | 221 |
| Reverse | 5'-atggtgagagagccttcataca-3' | 22 | 554 | 222 |

TABLE OB

CNS_neurodegeneration_v1.0

| Tissue Name | Rel. Exp. (%) Ag1755, Run 207575668 | Tissue Name | Rel. Exp. (%) Ag1755, Run 207575668 |
|---|---|---|---|
| AD 1 Hippo | 18.2 | Control (Path) 3 Temporal Ctx | 8.0 |
| AD 2 Hippo | 85.3 | Control (Path) 4 Temporal Ctx | 29.1 |
| AD 3 Hippo | 4.9 | AD 1 Occipital Ctx | 17.2 |
| AD 4 Hippo | 7.9 | AD 2 Occipital Ctx (Missing) | 0.0 |
| AD 5 Hippo | 46.3 | AD 3 Occipital Ctx | 6.3 |
| AD 6 Hippo | 58.2 | AD 4 Occipital Ctx | 14.5 |
| Control 2 Hippo | 15.7 | AD 5 Occipital Ctx | 31.9 |
| Control 4 Hippo | 16.3 | AD 5 Occipital Ctx | 20.9 |
| Control (Path) 3 Hippo | 6.8 | Control 1 Occipital Ctx | 2.0 |
| AD 1 Temporal Ctx | 10.2 | Control 2 Occipital Ctx | 31.4 |
| AD 2 Temporal Ctx | 29.9 | Control 3 Occipital Ctx | 7.3 |
| AD 3 Temporal Ctx | 5.3 | Control 4 Occipital Ctx | 12.0 |
| AD 4 Temporal Ctx | 22.4 | Control (Path) 1 Occipital Ctx | 45.7 |
| AD 5 Inf Temporal Ctx | 100.0 | Control (Path) 2 Occipital Ctx | 5.7 |
| AD 5 SupTemporal Ctx | 44.1 | Control (Path) 3 Occipital Ctx | 4.5 |
| AD 6 Inf Temporal Ctx | 48.0 | Control (Path) 4 Occipital Ctx | 7.4 |
| AD 6 Sup Temporal Ctx | 39.5 | Control 1 Parietal Ctx | 4.8 |
| Control 1 Temporal Ctx | 8.0 | Control 2 Parietal Ctx | 42.9 |
| Control 2 Temporal Ctx | 26.2 | Control 3 Parietal Ctx | 10.2 |
| Control 3 Temporal Ctx | 16.4 | Control (Path) 1 Parietal Ctx | 60.3 |
| Control 3 Temporal Ctx | 16.6 | Control (Path) 2 Parietal Ctx | 45.4 |
| Control (Path) 1 Temporal Ctx | 37.9 | Control (Path) 3 Parietal Ctx | 4.0 |
| Control (Path) 2 Temporal Ctx | 20.3 | Control (Path) 4 Parietal Ctx | 25.3 |

TABLE OC

Panel 1.3D

| Tissue Name | Rel. Exp. (%) Ag1755, Run 156004886 | Tissue Name | Rel. Exp. (%) Ag1755, Run 156004886 |
|---|---|---|---|
| Liver adenocarcinoma | 0.0 | Kidney (fetal) | 8.5 |
| Pancreas | 1.6 | Renal ca. 786-0 | 0.0 |
| Pancreatic ca. CAPAN 2 | 0.0 | Renal ca. A498 | 4.7 |
| Adrenal gland | 1.8 | Renal ca. RXF 393 | 0.0 |
| Thyroid | 0.7 | Renal ca. ACHN | 0.0 |
| Salivary gland | 7.9 | Renal ca. UO-31 | 0.0 |
| Pituitary gland | 36.6 | Renal ca. TK-10 | 0.0 |
| Brain (fetal) | 3.4 | Liver | 0.0 |
| Brain (whole) | 25.0 | Liver (fetal) | 17.7 |
| Brain (amygdala) | 14.0 | Liver ca. (hepatoblast) HepG2 | 0.0 |
| Brain (cerebellum) | 66.0 | Lung | 7.9 |
| Brain (hippocampus) | 33.0 | Lung (fetal) | 8.4 |
| Brain (substantia nigra) | 3.5 | Lung ca. (small cell) LX-1 | 4.5 |
| Brain (thalamus) | 16.3 | Lung ca. (small cell) NCI-H69 | 40.1 |
| Cerebral Cortex | 17.7 | Lung ca. (s.cell var.) SHP-77 | 100.0 |
| Spinal cord | 6.7 | Lung ca. (large cell) NCI-H460 | 1.2 |
| glio/astro U87-MG | 0.0 | Lung ca. (non-sm. cell) A549 | 4.8 |
| glio/astro U-118-MG | 0.0 | Lung ca. (non-s.cell) NCI-H23 | 0.1 |
| astrocytoma SW1783 | 0.0 | Lung ca. (non-s.cell) HOP-62 | 1.5 |
| neuro*; met SK-N-AS | 0.0 | Lung ca. (non-s.cl) NCI-H522 | 0.0 |
| astrocytoma SF-539 | 0.0 | Lung ca. (squam.) SW 900 | 0.7 |
| astrocytoma SNB-75 | 8.8 | Lung ca. (squam.) NCI-H596 | 13.7 |
| glioma SNB-19 | 0.0 | Mammary gland | 17.8 |
| glioma U251 | 3.2 | Breast ca.* (pl.ef) MCF-7 | 26.6 |
| glioma SF-295 | 1.6 | Breast ca.* (pl.ef) MDA-MB-231 | 0.0 |
| Heart (Fetal) | 5.8 | Breast ca.* (pl. ef) T47D | 16.3 |
| Heart | 4.2 | Breast ca. BT-549 | 0.3 |
| Skeletal muscle (Fetal) | 6.5 | Breast ca. MDA-N | 20.6 |
| Skeletal muscle | 1.3 | Ovary | 0.1 |
| Bone marrow | 5.3 | Ovarian ca. OVCAR-3 | 8.2 |
| Thymus | 2.4 | Ovarian ca. OVCAR-4 | 0.1 |
| Spleen | 1.1 | Ovarian ca. OVCAR-5 | 1.2 |
| Lymph node | 0.5 | Ovarian ca. OVCAR-8 | 1.3 |
| Colorectal | 1.6 | Ovarian ca. IGROV-1 | 0.3 |
| Stomach | 15.2 | Ovarian ca. (ascites) SK-OV-3 | 1.0 |
| Small intestine | 6.3 | Uterus | 2.0 |
| Colon ca. SW480 | 1.2 | Placenta | 12.9 |
| Colon ca.* SW620 (SW480 met) | 1.6 | Prostate | 1.2 |
| Colon ca. HT29 | 0.4 | Prostate ca.* (bone met) PC-3 | 0.0 |
| Colon ca. HCT-116 | 0.5 | Testis | 20.2 |
| Colon ca. CaCo-2 | 1.7 | Melanoma Hs688(A).T | 0.1 |
| CC Well to Mod Diff (ODO3866) | 0.3 | Melanoma* (met) Hs688(B).T | 0.0 |
| Colon ca. HCC-2998 | 0.0 | Melanoma UACC-62 | 0.8 |
| Gastric ca. (liver met) NCI-N87 | 0.2 | Melanoma M14 | 1.7 |
| Bladder | 0.9 | Melanoma LOX IMVI | 0.1 |
| Trachea | 24.0 | Melanoma* (met) SK-MEL-5 | 40.9 |
| Kidney | 4.2 | Adipose | 1.4 |

TABLE OD

Panel 2D

| Tissue Name | Rel. Exp. (%) Ag1755, Run 156005430 | Tissue Name | Rel. Exp. (%) Ag1755, Run 156005430 |
|---|---|---|---|
| Normal Colon | 12.1 | Kidney Margin 8120608 | 4.2 |
| CC Well to Mod Diff (ODO3866) | 0.8 | Kidney Cancer 8120613 | 0.4 |
| CC Margin (ODO3866) | 2.8 | Kidney Margin 8120614 | 2.3 |
| CC Gr.2 rectosigmoid (ODO3868) | 1.3 | Kidney Cancer 9010320 | 0.7 |

TABLE OD-continued

Panel 2D

| Tissue Name | Rel. Exp. (%) Ag1755, Run 156005430 | Tissue Name | Rel. Exp. (%) Ag1755, Run 156005430 |
|---|---|---|---|
| CC Margin (ODO3868) | 0.7 | Kidney Margin 9010321 | 4.1 |
| CC Mod Diff (ODO3920) | 1.4 | Normal Uterus | 0.5 |
| CC Margin (ODO3920) | 2.6 | Uterine Cancer 064011 | 40.3 |
| CC Gr.2 ascend colon (ODO3921) | 8.5 | Normal Thyroid | 2.0 |
| CC Margin (ODO3921) | 5.4 | Thyroid Cancer | 0.6 |
| CC from Partial Hepatectomy (ODO4309) Mets | 0.4 | Thyroid Cancer A302152 | 0.4 |
| Liver Margin (ODO4309) | 0.8 | Thyroid Margin A302153 | 0.5 |
| Colon mets to lung (OD04451-01) | 1.8 | Normal Breast | 22.2 |
| Lung Margin (OD04451-02) | 1.8 | Breast Cancer | 1.3 |
| Normal Prostate 6546-1 | 1.8 | Breast Cancer (OD04590-01) | 14.0 |
| Prostate Cancer (OD04410) | 1.3 | Breast Cancer Mets (OD04590-03) | 17.3 |
| Prostate Margin (OD04410) | 8.3 | Breast Cancer Metastasis | 40.9 |
| Prostate Cancer (OD04720-01) | 2.9 | Breast Cancer | 8.4 |
| Prostate Margin (OD04720-02) | 5.2 | Breast Cancer | 27.5 |
| Normal Lung | 9.4 | Breast Cancer 9100266 | 28.3 |
| Lung Met to Muscle (ODO4286) | 0.6 | Breast Margin 9100265 | 9.2 |
| Muscle Margin (ODO4286) | 3.2 | Breast Cancer A209073 | 27.0 |
| Lung Malignant Cancer (OD03126) | 30.1 | Breast Margin A2090734 | 24.3 |
| Lung Margin (OD03126) | 11.2 | Normal Liver | 0.0 |
| Lung Cancer (OD04404) | 5.6 | Liver Cancer | 0.0 |
| Lung Margin (OD04404) | 2.0 | Liver Cancer 1025 | 0.0 |
| Lung Cancer (OD04565) | 0.0 | Liver Cancer 1026 | 0.5 |
| Lung Margin (OD04565) | 0.8 | Liver Cancer 6004-T | 0.0 |
| Lung Cancer (OD04237-01) | 0.8 | Liver Tissue 6004-N | 0.3 |
| Lung Margin (OD04237-02) | 5.7 | Liver Cancer 6005-T | 0.3 |
| Ocular Mel Met to Liver (ODO4310) | 0.3 | Liver Tissue 6005-N | 0.0 |
| Liver Margin (ODO4310) | 0.0 | Normal Bladder | 3.1 |
| Melanoma Metastasis | 11.3 | Bladder Cancer | 5.4 |
| Lung Margin (OD04321) | 7.3 | Bladder Cancer | 0.4 |
| Normal Kidney | 52.9 | Bladder Cancer (OD04718-01) | 3.7 |
| Kidney Ca, Nuclear grade 2 (OD04338) | 1.7 | Bladder Normal Adjacent (OD04718-03) | 1.5 |
| Kidney Margin (OD04338) | 23.7 | Normal Ovary | 0.4 |
| Kidney Ca Nuclear grade 1/2 (OD04339) | 0.2 | Ovarian Cancer | 100.0 |
| Kidney Margin (OD04339) | 8.0 | Ovarian Cancer (OD04768-07) | 0.8 |
| Kidney Ca, Clear cell type (OD04340) | 5.0 | Ovary Margin (OD04768-08) | 0.7 |
| Kidney Margin (OD04340) | 17.7 | Normal Stomach | 8.1 |
| Kidney Ca, Nuclear grade 3 (OD04348) | 0.2 | Gastric Cancer 9060358 | 2.3 |
| Kidney Margin (OD04348) | 10.7 | Stomach Margin 9060359 | 15.7 |
| Kidney Cancer (OD04622-01) | 0.3 | Gastric Cancer 9060395 | 1.6 |
| Kidney Margin (OD04622-03) | 7.4 | Stomach Margin 9060394 | 6.5 |
| Kidney Cancer (OD04450-01) | 0.2 | Gastric Cancer 9060397 | 11.3 |
| Kidney Margin (0D04450-03) | 19.9 | Stomach Margin 9060396 | 2.9 |
| Kidney Cancer 8120607 | 0.6 | Gastric Cancer 064005 | 19.2 |

TABLE OE

Panel 3D

| Tissue Name | Rel. Exp. (%) Ag1755, Run 166618687 | Tissue Name | Rel. Exp. (%) Ag1755, Run 166618687 |
|---|---|---|---|
| Daoy-Medulloblastoma | 0.7 | Ca Ski-Cervical epidermoid carcinoma (metastasis) | 0.0 |
| TE671-Medulloblastoma | 0.0 | ES-2-Ovarian clear cell carcinoma | 0.4 |
| D283 Med-Medulloblastoma | 0.0 | Ramos-Stimulated with PMA/ionomycin 6 h | 1.8 |
| PFSK-1-Primitive Neuroectodermal | 0.1 | Ramos-Stimulated with PMA/ionomycin 14 h | 2.0 |
| XF-498-CNS | 8.4 | MEG-01-Chronic myelogenous leukemia (megokaryoblast) | 14.2 |
| SNB-78-Glioma | 0.0 | Raji-Burkitt's lymphoma | 0.0 |
| SF-268-Glioblastoma | 0.1 | Daudi-Burkitt's lymphoma | 0.0 |
| T98G-Glioblastoma | 0.6 | U266-B-cell plasmacytoma | 0.0 |
| SK-N-SH-Neuroblastoma (metastasis) | 0.0 | CA46-Burkitt's lymphoma | 0.0 |
| SF-295-Glioblastoma | 0.3 | RL-non-Hodgkin's B-cell lymphoma | 0.0 |
| Cerebellum | 36.1 | JM1-pre-B-cell lymphoma | 0.0 |
| Cerebellum | 14.5 | Jurkat-T cell leukemia | 5.5 |
| NCI-H292-Mucoepidermoid lung carcinoma | 0.0 | TF-1-Erythroleukemia | 57.0 |
| DMS-114-Small cell lung cancer | 7.8 | HUT 78-T-cell lymphoma | 4.8 |
| DMS-79-Small cell lung cancer | 57.0 | U937-Histiocytic lymphoma | 0.0 |
| NCI-H146-Small cell lung cancer | 24.1 | KU-812-Myelogenous leukemia | 26.8 |
| NCI-H526-Small cell lung cancer | 6.9 | 769-P-Clear cell renal carcinoma | 0.0 |
| NCI-N417-Small cell lung cancer | 0.0 | Caki-2-Clear cell renal carcinoma | 16.5 |
| NCI-H82-Small cell lung cancer | 0.0 | SW 839-Clear cell renal carcinoma | 0.0 |
| NCI-H157-Squamous cell lung cancer (metastasis) | 0.1 | G401-Wilms' tumor | 0.0 |
| NCI-H1155-Large cell lung cancer | 7.1 | Hs766T-Pancreatic carcinoma (LN metastasis) | 3.6 |
| NCI-H1299-Large cell lung cancer | 0.0 | CAPAN-1-Pancreatic adenocarcinoma (liver metastasis) | 0.1 |
| NCI-H727-Lung carcinoid | 20.0 | SU86.86-Pancreatic carcinoma (liver metastasis) | 4.8 |
| NCI-UMC-11-Lung carcinoid | 100.0 | BxPC-3-Pancreatic adenocarcinoma | 0.0 |
| LX-1-Small cell lung cancer | 4.5 | HPAC-Pancreatic adenocarcinoma | 0.0 |
| Colo-205-Colon cancer | 3.9 | MIA PaCa-2-Pancreatic carcinoma | 2.7 |
| KM12-Colon cancer | 0.6 | CFPAC-1-Pancreatic ductal adenocarcinoma | 0.6 |
| KM20L2-Colon cancer | 0.0 | PANC-1-Pancreatic epithelioid ductal carcinoma | 20.0 |
| NCI-H716-Colon cancer | 0.2 | T24-Bladder carcinma (transitional cell) | 0.0 |
| SW-48-Colon adenocarcinoma | 0.1 | 5637-Bladder carcinoma | 0.0 |
| SW1116-Colon adenocarcinoma | 0.1 | HT-1197-Bladder carcinoma | 0.0 |
| LS 174T-Colon adenocarcinoma | 0.0 | UM-UC-3-Bladder carcinma (transitional cell) | 0.0 |
| SW-948-Colon adenocarcinoma | 0.0 | A204-Rhabdomyosarcoma | 0.5 |
| SW-480-Colon adenocarcinoma | 0.1 | HT-1080-Fibrosarcoma | 0.0 |
| NCI-SNU-5-Gastric carcinoma | 0.0 | MG-63-Osteosarcoma | 0.0 |
| KATO III-Gastric carcinoma | 0.0 | SK-LMS-1-Leiomyosarcoma (vulva) | 0.0 |
| NCI-SNU-16-Gastric carcinoma | 0.0 | SJRH30-Rhabdomyosarcoma (met to bone marrow) | 0.0 |
| NCI-SNU-1-Gastric carcinoma | 12.3 | A431-Epidermoid carcinoma | 0.0 |

TABLE OE-continued

Panel 3D

| Tissue Name | Rel. Exp. (%) Ag1755, Run 166618687 | Tissue Name | Rel. Exp. (%) Ag1755, Run 166618687 |
|---|---|---|---|
| RF-1-Gastric adenocarcinoma | 0.0 | WM266-4-Melanoma | 1.9 |
| RF-48-Gastric adenocarcinoma | 0.0 | DU 145-Prostate carcinoma (brain metastasis) | 0.0 |
| MKN-45-Gastric carcinoma | 0.0 | MDA-MB-468-Breast adenocarcinoma | 0.0 |
| NCI-N87-Gastric carcinoma | 0.1 | SCC-4-Squamous cell carcinoma of tongue | 0.0 |
| OVCAR-5-Ovarian carcinoma | 0.1 | SCC-9-Squamous cell carcinoma of tongue | 0.0 |
| RL95-2-Uterine carcinoma | 0.0 | SCC-15-Squamous cell carcinoma of tongue | 0.0 |
| HelaS3-Cervical adenocarcinoma | 0.0 | CAL 27-Squamous cell carcinoma of tongue | 0.0 |

TABLE OF

Panel 4D

| Tissue Name | Rel. Exp. (%) Ag1755, Run 156005437 | Tissue Name | Rel. Exp. (%) Ag1755, Run 156005437 |
|---|---|---|---|
| Secondary Th1 act | 0.1 | HUVEC IL-1beta | 1.7 |
| Secondary Th2 act | 0.0 | HUVEC IFN gamma | 0.4 |
| Secondary Tr1 act | 0.1 | HUVEC TNF alpha + IFN gamma | 3.1 |
| Secondary Th1 rest | 0.0 | HUVEC TNF alpha + IL4 | 2.1 |
| Secondary Th2 rest | 0.0 | HUVEC IL-11 | 0.2 |
| Secondary Tr1 rest | 0.1 | Lung Microvascular EC none | 0.0 |
| Primary Th1 act | 0.2 | Lung Microvascular EC TNF alpha + IL-1beta | 0.1 |
| Primary Th2 act | 0.2 | Microvascular Dermal EC none | 0.0 |
| Primary Tr1 act | 0.4 | Microsvascular Dermal EC TNF alpha + IL-1beta | 0.4 |
| Primary Th1 rest | 0.0 | Bronchial epithelium TNF alpha + IL1beta | 0.0 |
| Primary Th2 rest | 0.0 | Small airway epithelium none | 0.1 |
| Primary Tr1 rest | 0.0 | Small airway epithelium TNF alpha + IL-1beta | 0.7 |
| CD45RA CD4 lymphocyte act | 0.1 | Coronery artery SMC rest | 0.1 |
| CD45RO CD4 lymphocyte act | 0.2 | Coronery artery SMC TNF alpha + IL-1beta | 0.1 |
| CD8 lymphocyte act | 0.0 | Astrocytes rest | 0.1 |
| Secondary CD8 lymphocyte rest | 0.0 | Astrocytes TNF alpha + IL-1beta | 0.2 |
| Secondary CD8 lymphocyte act | 0.0 | KU-812 (Basophil) rest | 23.8 |
| CD4 lymphocyte none | 0.1 | KU-812 (Basophil) PMA/ionomycin | 100.0 |
| 2ry Th1/Th2/Tr1_anti-CD95 CH11 | 0.0 | CCD1106 (Keratinocytes) none | 0.0 |
| LAK cells rest | 0.3 | CCD1106 (Keratinocytes) TNF alpha + IL-1beta | 0.0 |
| LAK cells IL-2 | 0.1 | Liver cirrhosis | 0.0 |
| LAK cells IL-2 + IL-12 | 0.7 | Lupus kidney | 1.1 |
| LAK cells IL-2 + IFN gamma | 0.3 | NCI-H292 none | 0.0 |
| LAK cells IL-2 + IL-18 | 0.2 | NCI-H292 IL-4 | 0.0 |
| LAK cells PMA/ionomycin | 0.2 | NCI-H292 IL-9 | 0.0 |
| NK Cells IL-2 rest | 0.0 | NCI-H292 IL-13 | 0.0 |
| Two Way MLR 3 day | 0.5 | NCI-H292 IFN gamma | 0.0 |
| Two Way MLR 5 day | 0.0 | HPAEC none | 1.7 |
| Two Way MLR 7 day | 0.0 | HPAEC TNF alpha + IL-1 beta | 12.9 |
| PBMC rest | 0.4 | Lung fibroblast none | 0.0 |
| PBMC PWM | 0.4 | Lung fibroblast TNF alpha + IL-1beta | 0.0 |
| PBMC PHA-L | 0.0 | Lung fibroblast IL-4 | 0.0 |

TABLE OF-continued

Panel 4D

| Tissue Name | Rel. Exp. (%) Ag1755, Run 156005437 | Tissue Name | Rel. Exp. (%) Ag1755, Run 156005437 |
|---|---|---|---|
| Ramos (B cell) none | 4.2 | Lung fibroblast IL-9 | 0.0 |
| Ramos (B cell) ionomycin | 9.1 | Lung fibroblast IL-13 | 0.0 |
| B lymphocytes PWM | 4.1 | Lung fibroblast IFN gamma | 0.0 |
| B lymphocytes CD40L and IL-4 | 1.3 | Dermal fibroblast CCD1070 rest | 0.1 |
| EOL-1 dbcAMP | 38.4 | Dermal fibroblast CCD1070 TNF alpha | 0.1 |
| EOL-1 dbcAMP PMA/ionomycin | 4.7 | Dermal fibroblast CCD1070 IL-1beta | 0.0 |
| Dendritic cells none | 0.0 | Dermal fibroblast IFN gamma | 0.0 |
| Dendritic cells LPS | 0.0 | Dermal fibroblast IL-4 | 0.1 |
| Dendritic cells anti-CD40 | 0.0 | IBD Colitis 2 | 0.2 |
| Monocytes rest | 0.4 | IBD Crohn's | 0.4 |
| Monocytes LPS | 0.0 | Colon | 2.3 |
| Macrophages rest | 0.0 | Lung | 1.2 |
| Macrophages LPS | 0.0 | Thymus | 13.1 |
| HUVEC none | 0.5 | Kidney | 3.4 |
| HUVEC starved | 0.3 | | |

CNS_neurodegeneration_v1.0 Summary: Ag1755 Panel CNS_Neurodegeneration does not detect any difference in the expression of this gene between the postmortem brains of controls or Alzheimer's disease patients. This panel does, however, confirm the expression of this gene at moderate to high levels in the brains of an independent group of patients. See panel 1.3d for discussion of utility in the central nervous system.

Panel 1.3D Summary: Ag1755 This gene, a carbonic anhydrase homolog, is widely expressed in this panel, with highest expression in a lung cancer cell line (CT=28.7). There appears to be significant expression in a cluster of lung cancer cell lines and in a melanoma cell line. Thus, expression of this gene could be used as a used as a diagnostic marker for the presence of these cancers. Conversely, the cancer cell lines from brain and kidney have low/undetectable levels of expression, while normal brain and kidney express this gene at significant levels. This suggests that absence of expression might be correlated to cell proliferation of these cell lines. It has been postulated that some carbonic anhydrases may contribute to the tumor microenvironment by maintaining extracellular acidic pH and helping cancer cells grow and metastasize. Therefore, therapeutic modulation of the expression or function of this gene may be effective in the treatment of these cancers.

This gene is moderately expressed in a variety of metabolic tissues including pancreas, adrenal, pituitary, adult and fetal heart, adult and fetal skeletal muscle, and adipose. Thus, this gene product may be a small molecule drug target for the treatment of metabolic disease, including obesity and Types 1 and 2 diabetes.

In addition, this gene is expressed at much higher levels in fetal liver (CT=31) when compared to expression in adult liver (CT=40) and may be used to differentiate between the adult and fetal sources of this tissue. Furthermore, the higher levels of expression in fetal liver suggests that therapeutic modulation of the expression or function of the protein encoded by this gene may be useful in the treatment of disease of the liver.

This gene encodes a protein that is homologous to a carbonic anhydrase and is expressed at moderate levels in all CNS regions examined. Activation of carbonic anhydrase ahs been shown to increase memory. Therefore, this gene is an excellent drug target for use as a memory enhancing agent or for the treatment of dementia (Alzheimer's type, vascular dementia, etc).

CA1 pyramidal cells were recorded in rat hippocampal slices. In the presence of carbonic anhydrase activators, comicrostimulation of cholinergic inputs from stratum oriens and gamma-aminobutyric acid (GABA)ergic inputs from stratum pyramidale at low intensities switched the hyperpolarizing GABA-mediated inhibitory postsynaptic potentials to depolarizing responses. In the absence of the activators, however, the same stimuli were insufficient to trigger the synaptic switch. This synaptic switch changed the function of the GABAergic synapses from excitation filter to amplifier and was prevented by carbonic anhydrase inhibitors, indicating a dependence on HCO. Intralateral ventricular administration of these same carbonic anhydrase activators caused the rats to exhibit superior learning of the Morris water maze task, suggesting that the GABAergic synaptic switch is critical for gating the synaptic plasticity that underlies spatial memory formation. Increased carbonic anhydrase activity might, therefore, also enhance perception, processing, and storing of temporally associated relevant signals and represents an important therapeutic target in learning and memory pharmacology. See Sun, M. K. and Alkon, D. L., *J Pharmacol Exp Ther,* 2001 June; 297(3):961–7.

Carbonic anhydrase-9 (CA9), a transmembrane enzyme with an extracellular active site, is involved in the reversible metabolism of carbon dioxide to carbonic acid. Up-regulation of CA by hypoxia and the hypoxia-inducible factor (HIF) pathway has been recently postulated. See Wykoff, et al., *Cancer Res.,* 60: 7075–7083, 2000. The expression of this enzyme in non-small cell lung cancer was recently examined and out of 107 cases analyzed, 39 (36.4%) had strong membrane/cytoplasmic expression of CA9 and were grouped as positive. The staining was confined around areas of necrosis, and a significant association of CA9 expression with the extent of necrosis was noted (P=0.004). Nevertheless, 38 of 74 cases with focal or extensive necrosis did not express CA9. CA9 expression was more frequent in the squamous cell histology (P=0.001) and with advanced T stage (P=0.009). Significantly CA9 was coexpressed with platelet-derived endothelial cell growth factor and basic fibroblast growth factor receptor. Double staining of CA9 with anti-CD31 monoclonal antibody revealed an overall higher microvessel density in the areas expressing CA9 than in negative areas (P=0.0005). Thirty-one of 38 CA9-positive cases were positive for HIF1a/HIF2a, but HIF positivity was a more common event (68 of 107) and their patterns of expression were diffuse (not confined in the necrotic areas). A direct association of CA9 expression with epidermal growth factor receptor, c-erbB-2, and MUC1 expression was also seen (P<0.04). Survival analysis showed that CA9 expression is related to poor prognosis. CA9 expression in tumors with low vascularization defined a prognosis similar to the one of patients with highly angiogenic tumors. Multivariate analysis revealed that CA9 expression is a significant prognostic factor independent of angiogenesis. Thus, CA9 is an important molecule in non-small cell lung cancer, the up-regulation of which occurs in highly hypoxic/necrotic regions of the tumors. The expression of CA9 is linked to the expression of a constellation of proteins involved in angiogenesis, apoptosis inhibition, and cell-cell adhesion disruption, which explains the strong association of CA9 with poor outcome. See Giatromanolaki, A., et al., *Cancer Res*, 2001 Nov. 1; 61(21):7992–8. PMID: 11691824

An acidic extracellular pH is a fundamental property of the malignant phenotype. In von Hippel-Lindau (VHL)-defective tumors the cell surface transmembrane carbonic anhydrase (CA) CA9 and CA12 genes are overexpressed because of the absence of pVHL. Therefore, these enzymes may be involved in maintaining the extracellular acidic pH in tumors, thereby providing a conducive environment for tumor growth and spread. Using Northern blot analysis and immunostaining with specific antibodies we analyzed the expression of CA9 and CA12 genes and their products in a large sample of cancer cell lines, fresh and archival tumor specimens, and normal human tissues. Expression was also analyzed in cultured cells under hypoxic conditions. Expression of CA IX and CA XII in normal adult tissues was detected only in highly specialized cells and for most tissues their expression did not overlap. Analysis of RNA samples isolated from 87 cancer cell lines and 18 tumors revealed high-to-moderate levels of expression of CA9 and CA12 in multiple cancers. Immunohistochemistry revealed high-to-moderate expression of these enzymes in various normal tissues and multiple common epithelial tumor types. The immunostaining was seen predominantly on the cell surface membrane. The expression of both genes was markedly induced under hypoxic conditions in tumors and cultured tumor cells. Thus, the cell surface trans-membrane carbonic anhydrases CA IX and CA XII are overexpressed in many tumors suggesting that this is a common feature of cancer cells that may be required for tumor progression. These enzymes may contribute to the tumor microenvironment by maintaining extracellular acidic pH and helping cancer cells grow and metastasize. Furthermore, there is an important causal link between hypoxia, extracellular acidification, and induction or enhanced expression of these enzymes in human tumors. See Ivanov, S., et al., *Am J Pathol*, 2001 March; 158(3):905–19. PMID: 11238039

Panel 2D Summary: Ag1755 This gene is widely expressed in this panel, with highest expression in ovarian cancer (CT=27.9). This gene also shows increased expression in normal prostate, stomach, muscle and kidney when compared to the matched adjacent tumors. Conversely, there is increased expression in uterine cancer compared to the matched normal tissue. Thus, the expression of this gene could be used as a diagnostic marker for these forms of cancer. Furthermore, therapeutic inhibition of the gene product may be useful in treating uterine cancer.

Panel 3D Summary: Ag1755 This gene was moderately expressed in a cluster of lung cancer cell lines, with highest expression in the lung cancer cell line NCI-UMC-11 (CT= 26.7). This pattern of expression reinforces the results seen in Panel 1.3D, where there are also significant levels of expression in several lung cancer cell lines. Thus, expression of this gene could be used to differentiate between these lung cancer cell lines and other samples on this panel.

Panel 4D Summary: Ag1755 This gene encodes a carbonic anhydrase-related protein and is expressed at moderate levels in untreated KU-812 basophil cells (CT=29.3) and at higher levels in KU-812 basophil cells treated with PMA/ionomycin (CT=27.2). These cells are a reasonable model for the inflammatory cells that take part in various inflammatory lung and bowel diseases, such as asthma, Crohn's disease, and ulcerative colitis. Small molecule antagonists that block the function of this gene product may be useful as therapeutics that reduce or eliminate the symptoms of patients suffering from asthma, Crohn's disease, and ulcerative colitis.

P. SNP14

CG53072-02: Protein Kinase SNF1-Like

Expression of gene CG53072-02 was assessed using the primer-probe sets Ag1542, Ag2369 and Ag1480, described in Tables PA, PB and PC. Results of the RTQ-PCR runs are shown in Tables PD, PE, PF, PG and PH.

TABLE PA

Probe Name Ag1542

| Primers | Sequences | Length | Start Position | SEQ ID NO |
|---|---|---|---|---|
| Forward | 5'-ctatcgtgaggttcagctgatg-3' | 22 | 213 | 223 |
| Probe | TET-5'-aagcttctgaaccatccacacatcat-3'-TAMRA | 26 | 235 | 224 |
| Reverse | 5'-cctttgtttccataacctggta-3' | 22 | 268 | 225 |

TABLE PB

Probe Name Ag2369

| Primers | Sequences | Length | Start Position | SEQ ID NO |
|---|---|---|---|---|
| Forward | 5'-tcagctgatgaagcttctgaac-3' | 22 | 225 | 226 |
| Probe | TET-5'-catccacacatcataaagctttaccagg-3'-TAMRA | 28 | 247 | 227 |
| Reverse | 5'-cgatgtaaagcatgtcctttgt-3' | 22 | 283 | 228 |

TABLE PC

Probe Name Ag1480

| Primers | Sequences | Length | Start Position | SEQ ID NO |
|---|---|---|---|---|
| Forward | 5'-aggttcagctgatgaagcttct-3' | 22 | 221 | 229 |
| Probe | TET-5'-ccatccacacatcataaagctttaccagg-3'-TAMRA | 29 | 246 | 230 |
| Reverse | 5'-cgatgtaaagcatgtcctttgt-3' | 22 | 283 | 231 |

TABLE PD

CNS_neurodegeneration_v1.0

| Tissue Name | Rel. Exp. (%) Ag1542, Run 207567501 | Rel. Exp. (%) Ag2369, Run 206262707 | Tissue Name | Rel. Exp. (%) Ag1542, Run 207567501 | Rel. Exp. (%) Ag2369, Run 206262707 |
|---|---|---|---|---|---|
| AD 1 Hippo | 5.5 | 5.4 | Control (Path) 3 Temporal Ctx | 11.2 | 15.9 |
| AD 2 Hippo | 11.0 | 11.5 | Control (Path) 4 Temporal Ctx | 8.2 | 6.8 |
| AD 3 Hippo | 9.7 | 5.1 | AD 1 Occipital Ctx | 4.9 | 6.1 |
| AD 4 Hippo | 7.3 | 5.5 | AD 2 Occipital Ctx (Missing) | 0.0 | 0.0 |
| AD 5 Hippo | 28.5 | 39.0 | AD 3 Occipital Ctx | 4.6 | 4.9 |
| AD 6 Hippo | 28.9 | 32.3 | AD 4 Occipital Ctx | 13.6 | 9.1 |
| Control 2 Hippo | 11.4 | 10.9 | AD 5 Occipital Ctx | 26.1 | 28.9 |
| Control 4 Hippo | 15.6 | 18.8 | AD 5 Occipital Ctx | 100.0 | 100.0 |
| Control (Path) 3 Hippo | 12.5 | 10.2 | Control 1 Occipital Ctx | 5.9 | 3.8 |
| AD 1 Temporal Ctx | 12.9 | 11.7 | Control 2 Occipital Ctx | 21.9 | 21.5 |
| AD 2 Temporal Ctx | 20.0 | 17.2 | Control 3 Occipital Ctx | 16.4 | 12.2 |
| AD 3 Temporal Ctx | 4.8 | 4.2 | Control 4 Occipital Ctx | 10.6 | 9.7 |
| AD 4 Temporal Ctx | 18.0 | 16.5 | Control (Path) 1 Occipital Ctx | 28.5 | 28.9 |
| AD 5 Inf Temporal Ctx | 20.0 | 27.4 | Control (Path) 2 Occipital Ctx | 5.1 | 4.2 |
| AD 5 Sup Temporal Ctx | 15.8 | 15.2 | Control (Path) 3 Occipital Ctx | 13.5 | 21.9 |
| AD 6 Inf Temporal Ctx | 28.9 | 34.4 | Control (Path) 4 Occipital Ctx | 7.9 | 6.0 |
| AD 6 Sup Temporal Ctx | 43.8 | 47.3 | Control 1 Parietal Ctx | 6.5 | 8.5 |
| Control 1 Temporal Ctx | 4.3 | 4.7 | Control 2 Parietal Ctx | 11.6 | 16.7 |
| Control 2 Temporal Ctx | 13.4 | 11.4 | Control 3 Parietal Ctx | 9.2 | 6.2 |
| Control 3 Temporal Ctx | 0.0 | 17.3 | Control (Path) 1 Parietal Ctx | 17.3 | 26.8 |
| Control 3 Temporal Ctx | 8.0 | 6.9 | Control (Path) 2 Parietal Ctx | 16.5 | 22.5 |

TABLE PD-continued

CNS_neurodegeneration_v1.0

| Tissue Name | Rel. Exp. (%) Ag1542, Run 207567501 | Rel. Exp. (%) Ag2369, Run 206262707 | Tissue Name | Rel. Exp. (%) Ag1542, Run 207567501 | Rel. Exp. (%) Ag2369, Run 206262707 |
|---|---|---|---|---|---|
| Control (Path) 1 Temporal Ctx | 23.3 | 26.6 | Control (Path) 3 Parietal Ctx | 21.8 | 18.4 |
| Control (Path) 2 Temporal Ctx | 21.9 | 18.9 | Control (Path) 4 Parietal Ctx | 8.5 | 12.6 |

TABLE PE

Panel 1.2

| Tissue Name | Rel. Exp. (%) Ag1480, Run 139627625 | Tissue Name | Rel. Exp. (%) Ag1480, Run 139627625 |
|---|---|---|---|
| Endothelial cells | 3.2 | Renal ca. 786-0 | 3.0 |
| Heart (Fetal) | 28.9 | Renal ca. A498 | 45.4 |
| Pancreas | 0.8 | Renal ca. RXF 393 | 17.2 |
| Pancreatic ca. CAPAN 2 | 2.2 | Renal ca. ACHN | 37.6 |
| Adrenal Gland | 34.9 | Renal ca. UO-31 | 19.3 |
| Thyroid | 0.4 | Renal ca. TK-10 | 18.2 |
| Salivary gland | 7.2 | Liver | 6.8 |
| Pituitary gland | 0.2 | Liver (fetal) | 9.8 |
| Brain (fetal) | 0.2 | Liver ca. (hepatoblast) HepG2 | 27.0 |
| Brain (whole) | 0.9 | Lung | 2.4 |
| Brain (amygdala) | 1.7 | Lung (fetal) | 1.6 |
| Brain (cerebellum) | 0.4 | Lung ca. (small cell) LX-1 | 8.8 |
| Brain (hippocampus) | 3.9 | Lung ca. (small cell) NCI-H69 | 7.4 |
| Brain (thalamus) | 3.1 | Lung ca. (s.cell var.) SHP-77 | 3.5 |
| Cerebral Cortex | 6.1 | Lung ca. (large cell) NCI-H460 | 100.0 |
| Spinal cord | 0.9 | Lung ca. (non-sm. cell) A549 | 76.8 |
| glio/astro U87-MG | 4.5 | Lung ca. (non-s.cell) NCI-H23 | 27.0 |
| glio/astro U-118-MG | 0.8 | Lung ca. (non-s.cell) HOP-62 | 6.5 |
| astrocytoma SW1783 | 3.3 | Lung ca. (non-s.cl) NCI-H522 | 3.6 |
| neuro*; met SK-N-AS | 0.8 | Lung ca. (squam.) SW 900 | 20.6 |
| astrocytoma SF-539 | 1.8 | Lung ca. (squam.) NCI-H596 | 11.5 |
| astrocytoma SNB-75 | 0.4 | Mammary gland | 10.8 |
| glioma SNB-19 | 0.4 | Breast ca.* (pl.ef) MCF-7 | 11.5 |
| glioma U251 | 1.6 | Breast ca.* (pl.ef) MDA-MB-231 | 3.3 |
| glioma SF-295 | 3.9 | Breast ca.* (pl. ef) T47D | 1.0 |
| Heart | 51.1 | Breast ca. BT-549 | 2.2 |
| Skeletal Muscle | 25.5 | Breast ca. MDA-N | 1.5 |
| Bone marrow | 1.6 | Ovary | 52.9 |
| Thymus | 0.2 | Ovarian ca. OVCAR-3 | 10.3 |
| Spleen | 9.3 | Ovarian ca. OVCAR-4 | 12.7 |
| Lymph node | 0.6 | Ovarian ca. OVCAR-5 | 9.6 |
| Colorectal | 14.1 | Ovarian ca. OVCAR-8 | 6.7 |
| Stomach | 2.5 | Ovarian ca. IGROV-1 | 3.1 |
| Small intestine | 4.1 | Ovarian ca. (ascites) SK-OV-3 | 23.7 |
| Colon ca. SW480 | 3.8 | Uterus | 1.7 |
| Colon ca.* SW620 (SW480 met) | 4.9 | Placenta | 2.5 |
| Colon ca. HT29 | 1.7 | Prostate | 11.2 |
| Colon ca. HCT-116 | 5.4 | Prostate ca.* (bone met) PC-3 | 15.5 |
| Colon ca. CaCo-2 | 8.6 | Testis | 0.8 |
| CC Well to Mod Diff (ODO3866) | 2.0 | Melanoma Hs688(A).T | 0.3 |
| Colon ca. HCC-2998 | 45.4 | Melanoma* (met) Hs688(B).T | 1.5 |
| Gastric ca. (liver met) NCI-N87 | 17.8 | Melanoma UACC-62 | 1.7 |
| Bladder | 16.3 | Melanoma M14 | 0.8 |
| Trachea | 2.0 | Melanoma LOX IMVI | 1.4 |
| Kidney | 10.7 | Melanoma* (met) SK-MEL-5 | 3.4 |
| Kidney (fetal) | 3.7 | | |

TABLE PF

Panel 1.3D

| Tissue Name | Rel. Exp. (%) Ag1542, Run 159823853 | Rel. Exp. (%) Ag2369, Run 162187069 | Tissue Name | Rel. Exp. (%) Ag1542, Run 159823853 | Rel. Exp. (%) Ag2369, Run 162187069 |
|---|---|---|---|---|---|
| Liver adenocarcinoma | 27.9 | 65.1 | Kidney (fetal) | 14.4 | 30.6 |
| Pancreas | 2.6 | 1.7 | Renal ca. 786-0 | 5.4 | 8.0 |
| Pancreatic ca. CAPAN 2 | 2.6 | 3.4 | Renal ca. A498 | 100.0 | 56.6 |
| Adrenal gland | 16.5 | 9.6 | Renal ca. RXF 393 | 13.9 | 44.4 |
| Thyroid | 4.6 | 4.3 | Renal ca. ACHN | 13.8 | 33.4 |
| Salivary gland | 1.9 | 3.8 | Renal ca. UO-31 | 8.4 | 11.4 |
| Pituitary gland | 9.7 | 7.5 | Renal ca. TK-10 | 8.0 | 10.1 |
| Brain (fetal) | 2.9 | 2.5 | Liver | 2.0 | 1.2 |
| Brain (whole) | 2.0 | 3.2 | Liver (fetal) | 17.0 | 10.1 |
| Brain (amygdala) | 3.6 | 2.9 | Liver ca. (hepatoblast) HepG2 | 17.8 | 21.5 |
| Brain (cerebellum) | 1.0 | 1.2 | Lung | 43.5 | 36.9 |
| Brain (hippocampus) | 20.2 | 7.7 | Lung (fetal) | 16.2 | 25.9 |
| Brain (substantia nigra) | 1.0 | 0.5 | Lung ca. (small cell) LX-1 | 2.8 | 4.3 |
| Brain (thalamus) | 3.3 | 3.4 | Lung ca. (small cell) NCI-H69 | 10.3 | 8.5 |
| Cerebral Cortex | 10.7 | 18.4 | Lung ca. (s.cell var.) SHP-77 | 20.6 | 29.9 |
| Spinal cord | 6.3 | 21.2 | Lung ca. (large cell)NCI-H460 | 25.5 | 43.8 |
| glio/astro U87-MG | 6.2 | 15.2 | Lung ca. (non-sm. cell) A549 | 63.3 | 69.3 |
| glio/astro U-118-MG | 7.1 | 1.9 | Lung ca. (non-s.cell) NCI-H23 | 25.5 | 37.9 |
| astrocytoma SW1783 | 10.6 | 33.0 | Lung ca. (non-s.cell) HOP-62 | 2.0 | 4.0 |
| neuro*; met SK-N-AS | 6.0 | 2.1 | Lung ca. (non-s.cl) NCI-H522 | 0.5 | 0.9 |
| astrocytoma SF-539 | 3.9 | 10.0 | Lung ca. (squam.) SW 900 | 8.5 | 14.2 |
| astrocytoma SNB-75 | 11.1 | 6.9 | Lung ca. (squam.) NCI-H596 | 3.9 | 8.5 |
| glioma SNB-19 | 0.4 | 2.5 | Mammary gland | 25.0 | 22.8 |
| glioma U251 | 2.4 | 3.8 | Breast ca.* (pl.ef) MCF-7 | 13.2 | 37.4 |
| glioma SF-295 | 2.9 | 6.3 | Breast ca.* (pl.ef) MDA-MB-231 | 48.6 | 11.3 |
| Heart (Fetal) | 38.7 | 68.8 | Breast ca.* (pl.ef) T47D | 0.9 | 0.3 |
| Heart | 6.1 | 19.5 | Breast ca. BT-549 | 15.4 | 4.3 |
| Skeletal muscle (Fetal) | 31.6 | 62.4 | Breast ca. MDA-N | 0.8 | 1.2 |
| Skeletal muscle | 3.4 | 17.0 | Ovary | 57.0 | 100.0 |
| Bone marrow | 3.7 | 2.4 | Ovarian ca. OVCAR-3 | 8.4 | 9.9 |
| Thymus | 2.1 | 14.5 | Ovarian ca. OVCAR-4 | 1.9 | 3.7 |
| Spleen | 16.8 | 27.9 | Ovarian ca. OVCAR-5 | 5.3 | 5.4 |
| Lymph node | 6.3 | 8.9 | Ovarian ca. OVCAR-8 | 7.9 | 12.4 |
| Colorectal | 13.8 | 28.9 | Ovarian ca. IGROV-1 | 1.4 | 1.5 |
| Stomach | 4.8 | 4.6 | Ovarian ca. (ascites) SK-OV-3 | 10.8 | 11.0 |
| Small intestine | 2.4 | 3.6 | Uterus | 3.5 | 4.0 |
| Colon ca. SW480 | 4.8 | 2.6 | Placenta | 15.8 | 15.2 |
| Colon ca.* SW620 (SW480 met) | 5.9 | 9.0 | Prostate | 4.9 | 4.9 |
| Colon ca. HT29 | 3.2 | 7.3 | Prostate ca.* (bone met) PC-3 | 6.1 | 9.9 |
| Colon ca. HCT-116 | 3.9 | 4.2 | Testis | 10.7 | 10.2 |
| Colon ca. CaCo-2 | 8.8 | 22.7 | Melanoma Hs688(A).T | 0.3 | 0.8 |
| CC Well to Mod Diff (ODO3866) | 20.0 | 33.4 | Melanoma* (met) Hs688(B).T | 1.0 | 4.1 |
| Colon ca. HCC-2998 | 42.3 | 16.0 | Melanoma UACC-62 | 0.4 | 0.6 |
| Gastric ca. (liver met) NCI-N87 | 37.6 | 30.8 | Melanoma M14 | 0.6 | 0.7 |
| Bladder | 3.1 | 20.0 | Melanoma LOX IMVI | 2.9 | 0.9 |

TABLE PF-continued

Panel 1.3D

| Tissue Name | Rel. Exp. (%) Ag1542, Run 159823853 | Rel. Exp. (%) Ag2369, Run 162187069 | Tissue Name | Rel. Exp. (%) Ag1542, Run 159823853 | Rel. Exp. (%) Ag2369, Run 162187069 |
|---|---|---|---|---|---|
| Trachea | 40.6 | 48.3 | Melanoma* (met) SK-MEL-5 | 2.7 | 2.4 |
| Kidney | 1.4 | 6.4 | Adipose | 55.1 | 84.1 |

TABLE PG

Panel 2D

| Tissue Name | Rel. Exp. (%) Ag1542, Run 159841683 | Tissue Name | Rel. Exp. (%) Ag1542, Run 159841683 |
|---|---|---|---|
| Normal Colon | 17.8 | Kidney Margin 8120608 | 5.9 |
| CC Well to Mod Diff (ODO3866) | 8.0 | Kidney Cancer 8120613 | 4.8 |
| CC Margin (ODO3866) | 21.5 | Kidney Margin 8120614 | 5.9 |
| CC Gr.2 rectosigmoid (ODO3868) | 2.2 | Kidney Cancer 9010320 | 18.8 |
| CC Margin (ODO3868) | 0.4 | Kidney Margin 9010321 | 11.3 |
| CC Mod Diff (ODO3920) | 3.3 | Normal Uterus | 2.4 |
| CC Margin (ODO3920) | 1.7 | Uterine Cancer 064011 | 27.2 |
| CC Gr.2 ascend colon (ODO3921) | 40.1 | Normal Thyroid | 4.1 |
| CC Margin (ODO3921) | 13.9 | Thyroid Cancer | 9.6 |
| CC from Partial Hepatectomy (ODO4309) Mets | 16.4 | Thyroid Cancer A302152 | 7.3 |
| Liver Margin (ODO4309) | 31.2 | Thyroid Margin A302153 | 4.6 |
| Colon mets to lung (OD04451-01) | 6.7 | Normal Breast | 22.4 |
| Lung Margin (OD04451-02) | 10.8 | Breast Cancer | 17.3 |
| Normal Prostate 6546-1 | 4.1 | Breast Cancer (OD04590-01) | 13.4 |
| Prostate Cancer (OD04410) | 7.6 | Breast Cancer Mets (OD04590-03) | 13.4 |
| Prostate Margin (OD04410) | 6.4 | Breast Cancer Metastasis | 4.2 |
| Prostate Cancer (OD04720-01) | 23.5 | Breast Cancer | 4.6 |
| Prostate Margin (OD04720-02) | 50.3 | Breast Cancer | 25.2 |
| Normal Lung | 34.2 | Breast Cancer 9100266 | 7.4 |
| Lung Met to Muscle (ODO4286) | 16.8 | Breast Margin 9100265 | 7.3 |
| Muscle Margin (ODO4286) | 16.6 | Breast Cancer A209073 | 4.0 |
| Lung Malignant Cancer (OD03126) | 25.5 | Breast Margin A2090734 | 3.0 |
| Lung Margin (OD03126) | 58.2 | Normal Liver | 0.3 |
| Lung Cancer (OD04404) | 27.4 | Liver Cancer | 5.6 |
| Lung Margin (OD04404) | 16.6 | Liver Cancer 1025 | 36.6 |
| Lung Cancer (OD04565) | 18.4 | Liver Cancer 1026 | 10.3 |
| Lung Margin (OD04565) | 9.7 | Liver Cancer 6004-T | 52.1 |
| Lung Cancer (OD04237-01) | 18.4 | Liver Tissue 6004-N | 19.2 |
| Lung Margin (OD04237-02) | 31.9 | Liver Cancer 6005-T | 8.4 |
| Ocular Mel Met to Liver (ODO4310) | 8.5 | Liver Tissue 6005-N | 12.9 |
| Liver Margin (ODO4310) | 37.1 | Normal Bladder | 13.5 |
| Melanoma Metastasis | 5.5 | Bladder Cancer | 5.0 |
| Lung Margin (OD04321) | 33.4 | Bladder Cancer | 5.6 |
| Normal Kidney | 4.3 | Bladder Cancer (OD04718-01) | 100.0 |
| Kidney Ca, Nuclear grade 2 (OD04338) | 9.6 | Bladder Normal Adjacent (OD04718-03) | 23.2 |
| Kidney Margin (OD04338) | 21.8 | Normal Ovary | 21.9 |
| Kidney Ca Nuclear grade 1/2 (OD04339) | 6.0 | Ovarian Cancer | 17.9 |
| Kidney Margin (OD04339) | 17.9 | Ovarian Cancer (OD04768-07) | 5.3 |
| Kidney Ca, Clear cell type (OD04340) | 18.2 | Ovary Margin (OD04768-08) | 18.2 |
| Kidney Margin (OD04340) | 29.1 | Normal Stomach | 31.2 |
| Kidney Ca, Nuclear grade 3 (OD04348) | 11.0 | Gastric Cancer 9060358 | 5.7 |
| Kidney Margin (OD04348) | 8.4 | Stomach Margin 9060359 | 21.6 |

TABLE PG-continued

Panel 2D

| Tissue Name | Rel. Exp. (%) Ag1542, Run 159841683 | Tissue Name | Rel. Exp. (%) Ag1542, Run 159841683 |
|---|---|---|---|
| Kidney Cancer (OD04622-01) | 19.1 | Gastric Cancer 9060395 | 14.5 |
| Kidney Margin (OD04622-03) | 7.7 | Stomach Margin 9060394 | 41.2 |
| Kidney Cancer (OD04450-01) | 4.5 | Gastric Cancer 9060397 | 11.3 |
| Kidney Margin (OD04450-03) | 11.5 | Stomach Margin 9060396 | 6.4 |
| Kidney Cancer 8120607 | 2.5 | Gastric Cancer 064005 | 20.3 |

TABLE PH

Panel 4D

| Tissue Name | Rel. Exp. (%) Ag1542, Run 159841886 | Rel. Exp. (%) Ag2369, Run 161683400 | Tissue Name | Rel. Exp. (%) Ag1542, Run 159841886 | Rel. Exp. (%) Ag2369, Run 161683400 |
|---|---|---|---|---|---|
| Secondary Th1 act | 0.6 | 0.3 | HUVEC IL-1beta | 0.7 | 0.4 |
| Secondary Th2 act | 1.0 | 0.6 | HUVEC IFN gamma | 0.3 | 0.3 |
| Secondary Tr1 act | 0.8 | 0.4 | HUVEC TNF alpha + IFN gamma | 1.3 | 1.1 |
| Secondary Th1 rest | 0.0 | 0.0 | HUVEC TNF alpha + IL4 | 0.9 | 1.1 |
| Secondary Th2 rest | 0.1 | 0.0 | HUVEC IL-11 | 0.3 | 0.2 |
| Secondary Tr1 rest | 0.1 | 0.0 | Lung Microvascular EC none | 1.1 | 2.4 |
| Primary Th1 act | 2.2 | 1.3 | Lung Microvascular EC TNF alpha + IL-1beta | 3.2 | 3.4 |
| Primary Th2 act | 1.5 | 1.0 | Microvascular Dermal EC none | 2.0 | 2.1 |
| Primary Tr1 act | 3.0 | 1.4 | Microsvasular Dermal EC TNF alpha + IL-1beta | 2.6 | 1.8 |
| Primary Th1 rest | 1.3 | 0.7 | Bronchial epithelium TNF alpha + IL1beta | 18.4 | 3.2 |
| Primary Th2 rest | 0.5 | 0.3 | Small airway epithelium none | 5.1 | 3.1 |
| Primary Tr1 rest | 1.4 | 1.0 | Small airway epithelium TNF alpha + IL-1beta | 21.9 | 20.9 |
| CD45RA CD4 lymphocyte act | 1.3 | 0.6 | Coronery artery SMC rest | 1.1 | 0.8 |
| CD45RO CD4 lymphocyte act | 0.9 | 0.5 | Coronery artery SMC TNF alpha + IL-1beta | 0.5 | 0.4 |
| CD8 lymphocyte act | 0.7 | 0.7 | Astrocytes rest | 1.5 | 1.4 |
| Secondary CD8 lymphocyte rest | 0.7 | 0.8 | Astrocytes TNF alpha + IL-1beta | 1.1 | 1.3 |
| Secondary CD8 lymphocyte act | 0.4 | 0.3 | KU-812 (Basophil) rest | 0.6 | 0.5 |
| CD4 lymphocyte none | 1.5 | 0.5 | KU-812 (Basophil) PMA/ionomycin | 0.9 | 1.2 |
| 2ry Th1/Th2/Tr1_anti-CD95 CH11 | 0.2 | 0.1 | CCD1106 (Keratinocytes) none | 10.6 | 11.7 |
| LAK cells rest | 1.3 | 0.9 | CCD1106 (Keratinocytes) TNF alpha + IL-1beta | 5.2 | 1.4 |

TABLE PH-continued

Panel 4D

| Tissue Name | Rel. Exp. (%) Ag1542, Run 159841886 | Rel. Exp. (%) Ag2369, Run 161683400 | Tissue Name | Rel. Exp. (%) Ag1542, Run 159841886 | Rel. Exp. (%) Ag2369, Run 161683400 |
|---|---|---|---|---|---|
| LAK cells IL-2 | 0.4 | 0.3 | Liver cirrhosis | 4.2 | 3.0 |
| LAK cells IL-2 + IL-12 | 1.5 | 1.3 | Lupus kidney | 1.1 | 0.7 |
| LAK cells IL-2 + IFN gamma | 2.2 | 1.3 | NCI-H292 none | 100.0 | 96.6 |
| LAK cells IL-2 + IL-18 | 1.9 | 1.0 | NCI-H292 IL-4 | 90.1 | 92.7 |
| LAK cells PMA/ionomycin | 12.8 | 9.3 | NCI-H292 IL-9 | 100.0 | 100.0 |
| NK Cells IL-2 rest | 0.4 | 0.2 | NCI-H292 IL-13 | 52.5 | 57.0 |
| Two Way MLR 3 day | 1.3 | 0.7 | NCI-H292 IFN gamma | 67.4 | 75.3 |
| Two Way MLR 5 day | 0.8 | 0.5 | HPAEC none | 0.7 | 0.3 |
| Two Way MLR 7 day | 0.2 | 0.3 | HPAEC TNF alpha + IL-1beta | 2.8 | 1.4 |
| PBMC rest | 3.0 | 1.9 | Lung fibroblast none | 0.1 | 0.2 |
| PBMC PWM | 4.4 | 3.0 | Lung fibroblast TNF alpha + IL-1 beta | 0.4 | 0.2 |
| PBMC PHA-L | 1.1 | 0.7 | Lung fibroblast IL-4 | 0.4 | 0.5 |
| Ramos (B cell) none | 1.0 | 0.6 | Lung fibroblast IL-9 | 0.2 | 0.3 |
| Ramos (B cell) ionomycin | 2.0 | 1.7 | Lung fibroblast IL-13 | 0.3 | 0.2 |
| B lymphocytes PWM | 5.9 | 5.7 | Lung fibroblast IFN gamma | 0.7 | 0.7 |
| B lymphocytes CD40L and IL-4 | 3.0 | 2.7 | Dermal fibroblast CCD1070 rest | 0.4 | 0.3 |
| EOL-1 dbcAMP | 1.0 | 0.8 | Dermal fibroblast CCD1070 TNF alpha | 0.7 | 0.5 |
| EOL-1 dbcAMP PMA/ionomycin | 1.9 | 1.5 | Dermal fibroblast CCD1070 IL-1 beta | 0.4 | 0.2 |
| Dendritic cells none | 0.3 | 0.2 | Dermal fibroblast IFN gamma | 0.1 | 0.2 |
| Dendritic cells LPS | 0.2 | 0.1 | Dermal fibroblast IL-4 | 0.1 | 0.0 |
| Dendritic cells anti-CD40 | 0.1 | 0.2 | IBD Colitis 2 | 0.7 | 0.5 |
| Monocytes rest | 0.6 | 0.6 | IBD Crohn's | 1.4 | 1.1 |
| Monocytes LPS | 0.5 | 0.4 | Colon | 2.9 | 2.6 |
| Macrophages rest | 1.1 | 0.6 | Lung | 6.8 | 6.2 |
| Macrophages LPS | 0.6 | 0.4 | Thymus | 2.6 | 1.8 |
| HUVEC none | 0.8 | 0.6 | Kidney | 9.6 | 8.5 |
| HUVEC starved | 1.0 | 0.6 | | | |

CNS_neurodegeneration_v1.0 Summary: Ag1542/Ag2369 Two experiments with two different probe and primer sets produce results that are in excellent agreement, with highest expression in the occipital cortex of a patient with Alzheimer's disease (CTs=27–28). While the expression profile in this panel does not show any differ in the expression of this gene in between the brains of patients with Alzheimer's and control brains, this panel does confirm expression of this gene at moderate to high levels in an independent group of patients. Please see Panel 1.3D for discussion of utility of this gene in the central nervous system.

Panel 1.2 Summary: Ag1480 This gene, a kinase homolog, is expressed at a low to moderate level in most of the cells and tissues used in this panel, with highest expression in a lung cancer cell line (CT=23.2). This ubiquitous expression suggests that the gene product plays a role in cell survival and proliferation for a majority of cell types. In addition, there is slightly increased expression of this gene in normal ovary (CT=24.12) compared to ovarian cancer cell lines. This suggests that expression of this gene could be used as a diagnostic marker for ovarian cancer.

Among tissues with metabolic function, this gene is highly expressed in adrenal, adult and fetal heart, skeletal muscle, and adult and fetal liver. It is also moderately expressed in pancreas, thyroid and pituitary. Thus, this kinase may be a small molecule drug target for the treatment of metabolic disease, including obesity and Types 1 and 2 diabetes.

The widespread expression in tissues that originate in the central nervous system confirms the expression of this gene in the brain. Please see Panel 1.3D for a discussion of potential utility in the central nervous system.

Panel 1.3D Summary: Ag1542/2369 Two experiments with two different probe and primer sets produce results that are in very good agreement, with highest expression in the ovary and a renal cancer cell line. Ubiquitous expression of the gene in these panels suggests that the gene product plays a role in cell survival and proliferation for a majority of cell types. In addition, there is slightly increased expression in normal ovary (CT=24.12) compared to ovarian cancer cell lines. This result is also seen in Panel 1.2 and suggests that expression of this gene could be used as a diagnostic marker for ovarian cancer. There is also increased expression in cell lines derived from kidney cancers compared with normal tissue, and thus expression of this gene could also be used as a diagnostic marker for the presence of kidney cancer. Furthermore, therapeutic inhibition of the expression or function of this gene could be used for treatment of these cancers.

This gene is moderately expressed in a wide variety of metabolic tissues including pancreas, adrenal, thyroid, pituitary, adult and fetal heart, adult and fetal skeletal muscle, and adipose. Thus, thiskinase may be a small molecule drug target for the treatment of metabolic disease, including obesity and Types 1 and 2 diabetes. This gene is differentially expressed in adult versus fetal liver and may be useful for to differentiate between adult and fetal liver.

This gene is homologous to a serine/theronine kinase and is expressed at low to moderate levels in all CNS regions examined, as is also seen in Panel 1.2 and CNS_neurodegeneration_v1.0. Serine/threonine kinases are activated by antidepressants. Thus, this gene may be a small molecule target for the treatment of depression or bipolar disorder.

It is currently widely accepted that adaptive, plastic changes in the molecular and cellular components of neuronal signaling systems correlate with the effects on mood and cognition observed after long-term treatment with antidepressant drugs. Protein phosphorylation represents a key step for most signaling systems, and it is involved in the regulation of virtually all cellular functions. Two serine/threonine kinases, Ca2+/calmodulin-dependent protein kinase II and cyclic AMP-dependent protein kinase, have been shown to be activated in the brain following antidepressant treatment. The changes in kinase activity are mirrored by changes in the phosphorylation of selected protein substrates in subcellular compartments (presynaptic terminals and microtubules), which, in turn, may contribute to the modulation of synaptic transmission observed with antidepressants. The molecular consequences of protein kinase activation may account for some of the alterations in neural function induced by antidepressants, and may suggest novel possible strategies of pharmacological intervention. See Popoli, M., et al., *Pharmacol Ther,* 2001 February; 89(2) :149–70.

Panel 2D Summary: Ag1542

This gene is expressed at a moderate level in all cancer and normal tissues used on this panel. The highest expression was seen in a sample of bladder cancer (CT=25.7). Furthermore, this gene appears to be overexpressed in bladder and liver cancer when compared to normal adjacent tissue. Thus, expression of this gene could be used as a marker for the presence of bladder or liver cancer. Furthermore, therapeutic modulation of the expression or function of this gene could be effective in the treatment of liver or bladder cancers. In general, the ubiquitous expression of this gene suggests that the protein encoded by this gene is required for survival and proliferation of many types of cells.

Panel 4D Summary: Two experiments with the different probe and primer sets produce results that are in very good agreement. This gene appears to be ubiquitously expressed among the samples on this panel, with highest expression in NCI-H292 pulmonary mucoepidermoid cells, both under resting conditions and also after stimulation by IL-4, IL-9, IL-13, or IFN-gamma (CTs=25). These cells constitute a model for mucus-secreting cells of the lung, and thus the activity of the gene product may be involved in one or more functions of these cells. Therefore, small molecule antagonists that block the function of the protein encoded by this gene may be useful as therapeutics to reduce or eliminate the symptoms of patients suffering from asthma, allergies, and emphysema.

Q. NOV12

4418354_0_9_da1: SEC6-Like

Expression of gene 4418354_0_9_da1 was assessed using the primer-probe sets Ag2801, Ag2802, Ag156, Ag892 and Ag2833, described in Tables QA, QB, QC, QD and QE. Results of the RTQ-PCR runs are shown in Tables QF, QG, QH, QI, QJ and QK.

TABLE QA

Probe Name Ag2801

| Primers | Sequences | Length | Start Position | SEQ ID NO |
|---|---|---|---|---|
| Forward | 5'-aaaattgacaggcgcatactt-3' | 21 | 765 | 232 |
| Probe | TET-5'-aaagcaaactggctttgttcctcctg-3'-TAMRA | 26 | 794 | 233 |
| Reverse | 5'-tccaagatggtgaacattttct-3' | 22 | 841 | 234 |

TABLE QB

Probe Name Ag2802

| Primers | Sequences | Length | Start Position | SEQ ID NO |
|---|---|---|---|---|
| Forward | 5'-acgggtactaccagaccacact-3' | 22 | 1354 | 235 |
| Probe | TET-5'-cctgccattgtcttccagatgtttga-3'-TAMRA | 26 | 1377 | 236 |
| Reverse | 5'-tctgagcagcaacttgaagatt-3' | 22 | 1407 | 237 |

TABLE QC

Probe Name Ag156

| Primers | Sequences | Length | Start Position | SEQ ID NO |
|---|---|---|---|---|
| Forward | 5'-agcaccatccacagctgctt-3' | 20 | 669 | 238 |
| Probe | TET-5'-ctcatcagagagcccctgcgtgc-3'-TAMRA | 23 | 640 | 239 |
| Reverse | 5'-tgaccctcatccatggctact-3' | 21 | 613 | 240 |

TABLE QD

Probe Name Ag892

| Primers | Sequences | Length | Start Position | SEQ ID NO |
|---|---|---|---|---|
| Forward | 5'-gtctgtctccttcatggtgaaa-3' | 22 | 98 | 241 |
| Probe | TET-5'-agctggtggaatcctcacactgttca-3'-TAMRA | 26 | 71 | 242 |
| Reverse | 5'-tagccgtagaggtgcacaga-3' | 20 | 37 | 243 |

TABLE QE

Probe Name Ag2833

| Primers | Sequences | Length | Start Position | SEQ ID NO |
|---|---|---|---|---|
| Forward | 5'-cgatcatgtactgaacgtagca-3' | 22 | 1557 | 244 |
| Probe | TET-5'-ctgccgattcctcaggtgctcttct-3'-TAMRA | 25 | 1523 | 245 |
| Reverse | 5'-aagatgaagcgcagctgtataa-3' | 22 | 1501 | 246 |

TABLE QF

CNS_neurodegeneration_v1.0

| Tissue Name | Rel. Exp. (%) Ag2801, Run 206989706 | Rel. Exp. (%) Ag2802, Run 206970534 | Tissue Name | Rel. Exp. (%) Ag2801, Run 206989706 | Rel. Exp. (%) Ag2802, Run 206970534 |
|---|---|---|---|---|---|
| AD 1 Hippo | 14.5 | 11.1 | Control (Path) 3 Temporal Ctx | 7.9 | 4.7 |
| AD 2 Hippo | 28.5 | 26.6 | Control (Path) 4 Temporal Ctx | 29.1 | 27.4 |
| AD 3 Hippo | 8.0 | 7.6 | AD 1 Occipital Ctx | 11.0 | 12.7 |
| AD 4 Hippo | 8.7 | 8.7 | AD 2 Occipital Ctx (Missing) | 0.0 | 0.0 |
| AD 5 Hippo | 96.6 | 80.1 | AD 3 Occipital Ctx | 6.5 | 6.0 |
| AD 6 Hippo | 58.2 | 51.1 | AD 4 Occipital Ctx | 17.2 | 22.5 |
| Control 2 Hippo | 28.5 | 24.0 | AD 5 Occipital Ctx | 21.0 | 20.4 |
| Control 4 Hippo | 11.1 | 11.0 | AD 5 Occipital Ctx | 45.4 | 55.1 |
| Control (Path) 3 Hippo | 7.6 | 7.0 | Control 1 Occipital Ctx | 4.0 | 3.7 |
| AD 1 Temporal Ctx | 16.4 | 9.7 | Control 2 Occipital Ctx | 58.2 | 70.7 |
| AD 2 Temporal Ctx | 28.3 | 21.5 | Control 3 Occipital Ctx | 15.9 | 12.7 |
| AD3 Temporal Ctx | 9.5 | 6.5 | Control 4 Occipital Ctx | 8.7 | 7.2 |
| AD 4 Temporal Ctx | 21.9 | 17.7 | Control (Path) 1 Occipital Ctx | 66.9 | 58.2 |
| AD 5 Inf Temporal Ctx | 100.0 | 100.0 | Control (Path) 2 Occipital Ctx | 13.2 | 10.4 |
| AD 5 Sup Temporal Ctx | 45.1 | 23.5 | Control (Path) 3 Occipital Ctx | 3.9 | 3.6 |

TABLE QF-continued

CNS_neurodegeneration_v1.0

| Tissue Name | Rel. Exp. (%) Ag2801, Run 206989706 | Rel. Exp. (%) Ag2802, Run 206970534 | Tissue Name | Rel. Exp. (%) Ag2801, Run 206989706 | Rel. Exp. (%) Ag2802, Run 206970534 |
|---|---|---|---|---|---|
| AD 6 Inf Temporal Ctx | 49.3 | 33.7 | Control (Path) 4 Occipital Ctx | 14.2 | 14.1 |
| AD 6 Sup Temporal Ctx | 52.1 | 36.6 | Control 1 Parietal Ctx | 9.5 | 6.9 |
| Control 1 Temporal Ctx | 8.8 | 6.7 | Control 2 Parietal Ctx | 49.0 | 29.7 |
| Control 2 Temporal Ctx | 45.1 | 46.7 | Control 3 Parietal Ctx | 21.0 | 22.2 |
| Control 3 Temporal Ctx | 14.6 | 12.4 | Control (Path) 1 Parietal Ctx | 65.5 | 64.6 |
| Control 3 Temporal Ctx | 11.2 | 7.5 | Control (Path) 2 Parietal Ctx | 27.5 | 19.1 |
| Control (Path) 1 Temporal Ctx | 54.3 | 50.3 | Control (Path) 3 Parietal Ctx | 4.9 | 6.4 |
| Control (Path) 2 Temporal Ctx | 37.1 | 24.3 | Control (Path) 4 Parietal Ctx | 47.6 | 37.6 |

TABLE QG

Panel 1

| Tissue Name | Rel. Exp. (%) Ag156, Run 109655283 | Tissue Name | Rel. Exp. (%) Ag156, Run 109655283 |
|---|---|---|---|
| Endothelial cells | 5.7 | Renal ca. 786-0 | 19.9 |
| Endothelial cells (treated) | 6.4 | Renal ca. A498 | 24.5 |
| Pancreas | 19.1 | Renal ca. RXF 393 | 3.6 |
| Pancreatic ca. CAPAN 2 | 17.1 | Renal ca. ACHN | 10.7 |
| Adrenal gland | 31.4 | Renal ca. UO-31 | 17.7 |
| Thyroid | 23.2 | Renal ca. TK-10 | 23.2 |
| Salivary gland | 27.9 | Liver | 16.5 |
| Pituitary gland | 15.1 | Liver (fetal) | 23.3 |
| Brain (fetal) | 8.4 | Liver ca. (hepatoblast) HepG2 | 34.9 |
| Brain (whole) | 13.6 | Lung | 14.9 |
| Brain (amygdala) | 32.8 | Lung (fetal) | 6.4 |
| Brain (cerebellum) | 36.6 | Lung ca. (small cell) LX-1 | 20.4 |
| Brain (hippocampus) | 37.6 | Lung ca. (small cell) NCI-H69 | 13.1 |
| Brain (substantia nigra) | 46.0 | Lung ca. (s.cell var.) SHP-77 | 15.7 |
| Brain (thalamus) | 46.3 | Lung ca. (large cell) NCI-H460 | 54.7 |
| Brain (hypothalamus) | 33.9 | Lung ca. (non-sm. cell) A549 | 33.9 |
| Spinal cord | 20.3 | Lung ca. (non-s.cell) NCI-H23 | 32.3 |
| glio/astro U87-MG | 24.0 | Lung ca. (non-s.cell) HOP-62 | 40.1 |
| glio/astro U-118-MG | 13.8 | Lung ca. (non-s.cl) NCI-H522 | 18.6 |
| astrocytoma SW1783 | 12.1 | Lung ca. (squam.) SW 900 | 59.9 |
| neuro*; met SK-N-AS | 32.3 | Lung ca. (squam.) NCI-H596 | 16.6 |
| astrocytoma SF-539 | 14.4 | Mammary gland | 29.9 |
| astrocytoma SNB-75 | 15.1 | Breast ca.* (pl.ef) MCF-7 | 100.0 |
| glioma SNB-19 | 25.3 | Breast ca.* (pl.ef) MDA-MB-231 | 16.7 |
| glioma U251 | 10.7 | Breast ca.* (pl. ef) T47D | 51.8 |
| glioma SF-295 | 21.0 | Breast ca. BT-549 | 18.9 |
| Heart | 35.4 | Breast ca. MDA-N | 41.2 |
| Skeletal muscle | 67.4 | Ovary | 34.2 |
| Bone marrow | 30.1 | Ovarian ca. OVCAR-3 | 35.8 |
| Thymus | 37.9 | Ovarian ca. OVCAR-4 | 6.6 |
| Spleen | 27.4 | Ovarian ca. OVCAR-5 | 35.1 |
| Lymph node | 12.7 | Ovarian ca. OVCAR-8 | 55.9 |
| Colon (ascending) | 29.3 | Ovarian ca. IGROV-1 | 21.5 |
| Stomach | 15.3 | Ovarian ca. (ascites) SK-OV-3 | 7.9 |
| Small intestine | 19.9 | Uterus | 31.2 |
| Colon ca. SW480 | 14.3 | Placenta | 29.5 |
| Colon ca.* SW620 (SW480 met) | 15.3 | Prostate | 26.2 |
| Colon ca. HT29 | 32.5 | Prostate ca.* (bone met) PC-3 | 53.2 |
| Colon ca. HCT-116 | 17.0 | Testis | 62.4 |
| Colon ca. CaCo-2 | 15.2 | Melanoma Hs688(A).T | 8.4 |
| Colon ca. HCT-15 | 42.0 | Melanoma* (met) Hs688(B).T | 12.9 |

TABLE QG-continued

Panel 1

| Tissue Name | Rel. Exp. (%) Ag156, Run 109655283 | Tissue Name | Rel. Exp. (%) Ag156, Run 109655283 |
|---|---|---|---|
| Colon ca. HCC-2998 | 64.6 | Melanoma UACC-62 | 26.2 |
| Gastric ca. (liver met) NCI-N87 | 51.8 | Melanoma M14 | 16.5 |
| Bladder | 54.7 | Melanoma LOX IMVI | 9.0 |
| Trachea | 16.7 | Melanoma* (met) SK-MEL-5 | 33.2 |
| Kidney | 50.7 | Melanoma SK-MEL-28 | 3.5 |
| Kidney (fetal) | 29.5 | | |

TABLE QH

Panel 1.2

| Tissue Name | Rel. Exp. (%) Ag892, Run 119094691 | Tissue Name | Rel. Exp. (%) Ag892, Run 119094691 |
|---|---|---|---|
| Endothelial cells | 0.0 | Renal ca. 786-0 | 3.7 |
| Heart (Fetal) | 5.8 | Renal ca. A498 | 12.2 |
| Pancreas | 41.5 | Renal ca. RXF 393 | 1.6 |
| Pancreatic ca. CAPAN 2 | 8.5 | Renal ca. ACHN | 6.5 |
| Adrenal gland | 22.5 | Renal ca. UO-31 | 4.1 |
| Thyroid | 32.8 | Renal ca. TK-10 | 11.9 |
| Salivary gland | 30.4 | Liver | 15.4 |
| Pituitary gland | 34.6 | Liver (fetal) | 8.4 |
| Brain (fetal) | 14.4 | Liver ca. (hepatoblast) HepG2 | 4.9 |
| Brain (whole) | 27.0 | Lung | 11.7 |
| Brain (amygdala) | 18.0 | Lung (fetal) | 11.7 |
| Brain (cerebellum) | 11.9 | Lung ca. (small cell) LX-1 | 17.3 |
| Brain (hippocampus) | 24.5 | Lung ca. (small cell) NCI-H69 | 6.5 |
| Brain (thalamus) | 17.0 | Lung ca. (s.cell var.) SHP-77 | 11.4 |
| Cerebral Cortex | 21.6 | Lung ca. (large cell) NCI-H460 | 17.1 |
| Spinal cord | 11.2 | Lung ca. (non-sm. cell) A549 | 15.5 |
| glio/astro U87-MG | 13.2 | Lung ca. (non-s.cell) NCI-H23 | 7.3 |
| glio/astro U-118-MG | 9.0 | Lung ca. (non-s.cell) HOP-62 | 19.1 |
| astrocytoma SW1783 | 5.2 | Lung ca. (non-s.cl) NCI-H522 | 20.2 |
| neuro*; met SK-N-AS | 34.9 | Lung ca. (squam.) SW 900 | 14.3 |
| astrocytoma SF-539 | 6.4 | Lung ca. (squam.) NCI-H596 | 7.4 |
| astrocytoma SNB-75 | 6.0 | Mammary gland | 23.5 |
| glioma SNB-19 | 9.8 | Breast ca.* (pl.ef) MCF-7 | 31.6 |
| glioma U251 | 11.7 | Breast ca.* (pl.ef) MDA-MB-231 | 6.5 |
| glioma SF-295 | 15.9 | Breast ca.* (pl. ef) T47D | 31.6 |
| Heart | 26.8 | Breast ca. BT-549 | 9.0 |
| Skeletal muscle | 100.0 | Breast ca. MDA-N | 16.0 |
| Bone marrow | 9.3 | Ovary | 10.1 |
| Thymus | 9.7 | Ovarian ca. OVCAR-3 | 18.7 |
| Spleen | 15.4 | Ovarian ca. OVCAR-4 | 3.6 |
| Lymph node | 20.4 | Ovarian ca. OVCAR-5 | 24.8 |
| Colorectal | 0.8 | Ovarian ca. OVCAR-8 | 5.6 |
| Stomach | 31.2 | Ovarian ca. IGROV-1 | 16.3 |
| Small intestine | 19.5 | Ovarian ca. (ascites) SK-OV-3 | 14.6 |
| Colon ca. SW480 | 5.1 | Uterus | 16.7 |
| Colon ca.* SW620 (SW480 met) | 12.9 | Placenta | 27.5 |
| Colon ca. HT29 | 10.9 | Prostate | 15.7 |
| Colon ca. HCT-116 | 7.8 | Prostate ca.* (bone met) PC-3 | 18.0 |
| Colon ca. CaCo-2 | 7.4 | Testis | 44.4 |
| CC Well to Mod Diff (ODO3866) | 1.5 | Melanoma Hs688(A).T | 4.3 |
| Colon ca. HCC-2998 | 33.2 | Melanoma* (met) Hs688(B).T | 4.2 |
| Gastric ca. (liver met) NCI-N87 | 39.8 | Melanoma UACC-62 | 9.0 |
| Bladder | 15.0 | Melanoma M14 | 5.7 |
| Trachea | 10.1 | Melanoma LOX IMVI | 7.1 |
| Kidney | 17.1 | Melanoma* (met) SK-MEL-5 | 15.8 |
| Kidney (fetal) | 19.3 | | |

TABLE QI

Panel 1.3D

| Tissue Name | Rel. Exp. (%) Ag2801, Run 165527194 | Rel. Exp. (%) Ag2802, Run 162303853 | Rel. Exp. (%) Ag2833, Run 153834282 | Tissue Name | Rel. Exp. (%) Ag2801, Run 165527194 | Rel. Exp. (%) Ag2802, Run 162303853 | Rel. Exp. (%) Ag2833, Run 153834282 |
|---|---|---|---|---|---|---|---|
| Liver adenocarcinoma | 36.9 | 31.0 | 16.7 | Kidney (fetal) | 13.8 | 11.4 | 10.6 |
| Pancreas | 12.3 | 1.8 | 8.1 | Renal ca. 786-0 | 18.8 | 6.3 | 10.1 |
| Pancreatic ca. CAPAN 2 | 25.3 | 2.0 | 6.8 | Renal ca. A498 | 41.8 | 10.4 | 19.2 |
| Adrenal gland | 12.9 | 5.3 | 9.3 | Renal ca. RXF 393 | 11.4 | 1.9 | 1.4 |
| Thyroid | 21.2 | 9.9 | 16.4 | Renal ca. ACHN | 8.1 | 4.4 | 5.0 |
| Salivary gland | 13.7 | 4.4 | 10.8 | Renal ca. UO-31 | 12.4 | 5.1 | 7.4 |
| Pituitary gland | 18.9 | 7.0 | 22.4 | Renal ca. TK-10 | 11.9 | 5.1 | 7.4 |
| Brain (fetal) | 31.0 | 4.8 | 8.5 | Liver | 6.2 | 1.6 | 4.6 |
| Brain (whole) | 84.7 | 12.3 | 30.6 | Liver (fetal) | 19.3 | 6.6 | 11.4 |
| Brain (amygdala) | 50.0 | 20.6 | 29.5 | Liver ca. (hepatoblast) HepG2 | 13.4 | 4.5 | 6.8 |
| Brain (cerebellum) | 56.6 | 11.2 | 8.6 | Lung | 10.5 | 9.2 | 18.3 |
| Brain (hippocampus) | 54.0 | 27.0 | 65.5 | Lung (fetal) | 10.4 | 6.9 | 23.0 |
| Brain (substantia nigra) | 33.2 | 5.9 | 8.6 | Lung ca. (small cell) LX-1 | 12.5 | 5.9 | 8.7 |
| Brain (thalamus) | 56.3 | 15.1 | 18.2 | Lung ca. (small cell) NCI-H69 | 2.3 | 3.5 | 11.4 |
| Cerebral Cortex | 60.7 | 85.3 | 100.0 | Lung ca. (s.cell var.) SHP-77 | 31.0 | 33.0 | 16.5 |
| Spinal cord | 19.5 | 15.3 | 13.3 | Lung ca. (large cell)NCI-H460 | 39.8 | 5.8 | 5.3 |
| glio/astro U87-MG | 16.4 | 21.0 | 14.9 | Lung ca. (non-sm. cell) A549 | 6.2 | 5.3 | 5.3 |
| glio/astro U-118-MG | 27.2 | 13.9 | 27.9 | Lung ca. (non-s.cell) NCI-H23 | 17.9 | 10.3 | 14.6 |
| astrocytoma SW1783 | 24.1 | 30.4 | 15.8 | Lung ca. (non-s.cell) HOP-62 | 16.4 | 12.2 | 10.9 |
| neuro*; met SK-N-AS | 23.8 | 8.6 | 32.3 | Lung Ca. (non-s.cl) NCI-H522 | 7.3 | 4.0 | 8.0 |
| astrocytoma SF-539 | 15.2 | 10.3 | 13.3 | Lung ca. (squam.) SW 900 | 34.9 | 6.3 | 14.8 |
| astrocytoma SNB-75 | 38.4 | 8.6 | 18.4 | Lung ca. (squam.) NCI-H596 | 8.8 | 2.1 | 3.4 |
| glioma SNB-19 | 18.4 | 10.3 | 9.3 | Mammary gland | 25.3 | 9.4 | 17.2 |
| glioma U251 | 39.5 | 6.5 | 7.2 | Breast ca.* (pl.ef) MCF-7 | 68.3 | 52.9 | 3.0 |
| glioma SF-295 | 18.7 | 16.6 | 17.3 | Breast ca.* (pl.ef) MDA-MB-231 | 36.3 | 7.0 | 15.9 |
| Heart (Fetal) | 8.5 | 22.2 | 23.0 | Breast ca.* (pl. ef) T47D | 20.0 | 11.0 | 26.1 |
| Heart | 16.8 | 11.9 | 5.4 | Breast Ca. BT-549 | 39.2 | 8.2 | 17.6 |

TABLE QI-continued

Panel 1.3D

| Tissue Name | Rel. Exp. (%) Ag2801, Run 165527194 | Rel. Exp. (%) Ag2802, Run 162303853 | Rel. Exp. (%) Ag2833, Run 153834282 | Tissue Name | Rel. Exp. (%) Ag2801, Run 165527194 | Rel. Exp. (%) Ag2802, Run 162303853 | Rel. Exp. (%) Ag2833, Run 153834282 |
|---|---|---|---|---|---|---|---|
| Skeletal muscle (Fetal) | 18.9 | 100.0 | 98.6 | Breast ca. MDA-N | 10.7 | 9.0 | 16.6 |
| Skeletal muscle | 100.0 | 54.3 | 13.2 | Ovary | 11.8 | 32.8 | 31.4 |
| Bone marrow | 17.1 | 5.9 | 15.6 | Ovarian ca. OVCAR-3 | 16.7 | 7.1 | 9.3 |
| Thymus | 15.6 | 33.4 | 11.9 | Ovarian ca. OVCAR-4 | 3.7 | 0.3 | 0.9 |
| Spleen | 27.7 | 11.4 | 25.3 | Ovarian ca. OVCAR-5 | 18.3 | 6.9 | 9.6 |
| Lymph node | 41.5 | 4.8 | 13.9 | Ovarian ca. OVCAR-8 | 5.3 | 6.6 | 10.4 |
| Colorectal | 16.4 | 17.0 | 20.2 | Ovarian ca. IGROV-1 | 6.9 | 2.7 | 4.8 |
| Stomach | 31.0 | 5.8 | 21.3 | Ovarian ca. (ascites) SK-OV-3 | 8.8 | 3.9 | 8.6 |
| Small intestine | 38.2 | 11.8 | 18.8 | Uterus | 35.4 | 5.3 | 9.2 |
| Colon ca. SW480 | 9.5 | 6.3 | 16.8 | Placenta | 11.8 | 7.7 | 14.8 |
| Colon ca.* SW620 (SW480 met) | 12.7 | 8.5 | 9.1 | Prostate | 11.9 | 6.1 | 15.5 |
| Colon ca. HT29 | 5.1 | 15.3 | 12.7 | Prostate ca.* (bone met) PC-3 | 9.0 | 4.2 | 6.9 |
| Colon ca. HCT-116 | 6.6 | 6.7 | 7.5 | Testis | 62.0 | 29.3 | 36.6 |
| Colon ca. CaCo-2 | 6.6 | 9.7 | 10.2 | Melanoma Hs688(A).T | 3.9 | 6.7 | 9.4 |
| CC Well to Mod Diff (ODO3866) | 15.0 | 11.0 | 9.9 | Melanoma* (met) Hs688(B).T | 8.4 | 7.6 | 12.6 |
| Colon ca. HCC-2998 | 19.3 | 10.7 | 17.3 | Melanoma UACC-62 | 18.4 | 5.4 | 3.3 |
| Gastric ca. (liver met) NCI-N87 | 48.0 | 23.0 | 24.3 | Melanoma M14 | 37.6 | 2.1 | 4.0 |
| Bladder | 15.6 | 16.8 | 12.4 | Melanoma LOX IMVI | 5.6 | 4.0 | 4.6 |
| Trachea | 20.7 | 17.6 | 19.5 | Melanoma* (met) SK-MEL-5 | 11.0 | 9.2 | 11.1 |
| Kidney | 15.5 | 15.7 | 7.4 | Adipose | 12.1 | 7.5 | 8.5 |

TABLE QJ

Panel 2D

| Tissue Name | Rel. Exp. (%) Ag2801, Run 162598698 | Rel. Exp. (%) Ag2802, Run 162303857 | Rel. Exp. (%) Ag2833, Run 153834324 | Tissue Name | Rel. Exp. (%) Ag2801, Run 162598698 | Rel. Exp. (%) Ag2802, Run 162303857 | Rel. Exp. (%) Ag2833, Run 153834324 |
|---|---|---|---|---|---|---|---|
| Normal Colon | 88.9 | 81.2 | 26.1 | Kidney Margin 8120608 | 22.4 | 23.8 | 7.5 |
| CC Well to Mod Diff (ODO3866) | 16.6 | 16.5 | 1.8 | Kidney Cancer 8120613 | 35.1 | 25.2 | 8.5 |
| CC Margin (ODO3866) | 15.7 | 12.5 | 4.4 | Kidney Margin 8120614 | 37.9 | 33.9 | 9.9 |
| CC Gr.2 | 20.0 | 15.9 | 8.1 | Kidney | 36.9 | 22.4 | 9.1 |

TABLE QJ-continued

Panel 2D

| Tissue Name | Rel. Exp. (%) Ag2801, Run 162598698 | Rel. Exp. (%) Ag2802, Run 162303857 | Rel. Exp. (%) Ag2833, Run 153834324 | Tissue Name | Rel. Exp. (%) Ag2801, Run 162598698 | Rel. Exp. (%) Ag2802, Run 162303857 | Rel. Exp. (%) Ag2833, Run 153834324 |
|---|---|---|---|---|---|---|---|
| rectosigmoid (ODO3868) CC Margin (ODO3868) | 11.1 | 7.6 | 3.1 | Cancer 9010320 Kidney Margin 9010321 | 43.8 | 37.4 | 10.2 |
| CC Mod Diff (ODO3920) | 74.7 | 40.9 | 23.3 | Normal Uterus | 12.2 | 12.0 | 3.0 |
| CC Margin (ODO3920) | 36.1 | 24.5 | 11.9 | Uterine Cancer 064011 | 39.2 | 33.7 | 11.1 |
| CC Gr.2 ascend colon (ODO3921) | 49.0 | 45.7 | 15.3 | Normal Thyroid | 33.0 | 27.5 | 12.9 |
| CC Margin (ODO3921) | 18.6 | 22.4 | 4.8 | Thyroid Cancer | 30.1 | 24.0 | 8.8 |
| CC from Partial Hepatectomy (ODO4309) Mets | 63.7 | 63.3 | 19.9 | Thyroid Cancer A302152 | 22.4 | 22.1 | 8.5 |
| Liver Margin (ODO4309) | 22.7 | 19.8 | 6.1 | Thyroid Margin A302153 | 34.2 | 30.1 | 13.1 |
| Colon mets to lung (OD04451-01) | 26.4 | 23.8 | 10.4 | Normal Breast | 40.6 | 26.1 | 12.7 |
| Lung Margin (OD04451-02) | 16.6 | 13.8 | 6.4 | Breast Cancer | 34.2 | 23.3 | 10.2 |
| Normal Prostate 6546-1 | 100.0 | 11.0 | 11.4 | Breast Cancer (OD04590-01) | 66.0 | 46.7 | 20.6 |
| Prostate Cancer (OD04410) | 62.9 | 38.7 | 13.4 | Breast Cancer Mets (OD04590-03) | 69.3 | 51.1 | 23.8 |
| Prostate Margin (OD04410) | 48.3 | 39.5 | 16.8 | Breast Cancer Metastasis | 54.3 | 45.7 | 15.7 |
| Prostate Cancer (OD04720-01) | 42.3 | 24.8 | 15.6 | Breast Cancer | 40.9 | 39.5 | 17.9 |
| Prostate Margin (OD04720-02) | 54.3 | 41.5 | 17.1 | Breast Cancer | 67.4 | 46.3 | 21.2 |
| Normal Lung | 55.1 | 47.0 | 21.5 | Breast Cancer 9100266 | 48.0 | 49.0 | 17.4 |
| Lung Met to Muscle (ODO4286) | 27.5 | 25.7 | 10.1 | Breast Margin 9100265 | 30.4 | 26.2 | 11.7 |
| Muscle Margin (ODO4286) | 27.0 | 28.7 | 11.9 | Breast Cancer A209073 | 39.0 | 37.9 | 12.9 |
| Lung Malignant Cancer (OD03126) | 39.8 | 27.5 | 9.5 | Breast Margin A2090734 | 25.3 | 26.1 | 12.2 |
| Lung Margin (OD03126) | 45.1 | 36.6 | 13.6 | Normal Liver | 11.9 | 9.4 | 4.7 |
| Lung Cancer (OD04404) | 32.5 | 34.6 | 11.6 | Liver Cancer | 11.0 | 12.3 | 3.8 |
| Lung Margin (OD04404) | 23.2 | 19.1 | 7.4 | Liver Cancer 1025 | 13.1 | 9.2 | 5.0 |

TABLE QJ-continued

Panel 2D

| Tissue Name | Rel. Exp. (%) Ag2801, Run 162598698 | Rel. Exp. (%) Ag2802, Run 162303857 | Rel. Exp. (%) Ag2833, Run 153834324 | Tissue Name | Rel. Exp. (%) Ag2801, Run 162598698 | Rel. Exp. (%) Ag2802, Run 162303857 | Rel. Exp. (%) Ag2833, Run 153834324 |
|---|---|---|---|---|---|---|---|
| Lung Cancer (OD04565) | 45.1 | 37.6 | 15.8 | Liver Cancer 1026 | 13.5 | 5.0 | 4.4 |
| Lung Margin (OD04565) | 17.2 | 13.2 | 9.0 | Liver Cancer 6004-T | 13.3 | 14.1 | 4.7 |
| Lung Cancer (OD04237-01) | 83.5 | 75.3 | 26.1 | Liver Tissue 6004-N | 18.0 | 13.1 | 6.0 |
| Lung Margin (OD04237-02) | 25.3 | 21.2 | 7.5 | Liver Cancer 6005-T | 15.6 | 12.0 | 3.7 |
| Ocular Mel Met to Liver (ODO4310) | 45.7 | 28.9 | 100.0 | Liver Tissue 6005-N | 6.3 | 4.8 | 1.2 |
| Liver Margin (ODO4310) | 14.3 | 10.2 | 3.8 | Normal Bladder | 49.7 | 51.1 | 21.6 |
| Melanoma Metastasis | 34.6 | 25.2 | 9.8 | Bladder Cancer | 18.0 | 12.4 | 5.8 |
| Lung Margin (OD04321) | 39.2 | 30.8 | 11.0 | Bladder Cancer | 31.9 | 27.0 | 10.8 |
| Normal Kidney | 65.5 | 55.9 | 22.5 | Bladder Cancer (OD04718-01) | 76.8 | 70.2 | 25.2 |
| Kidney Ca, Nuclear grade 2 (OD04338) | 52.1 | 37.6 | 21.0 | Bladder Normal Adjacent (OD04718-03) | 33.4 | 25.3 | 12.0 |
| Kidney Margin (OD04338) | 44.1 | 28.9 | 13.5 | Normal Ovary | 27.0 | 23.0 | 8.5 |
| Kidney Ca Nuclear grade 1/2 (OD04339) | 59.0 | 29.5 | 23.5 | Ovarian Cancer | 52.1 | 63.3 | 16.5 |
| Kidney Margin (OD04339) | 52.1 | 43.5 | 15.2 | Ovarian Cancer (OD04768-07) | 80.7 | 72.2 | 24.8 |
| Kidney Ca, Clear cell type (OD04340) | 96.6 | 100.0 | 57.4 | Ovary Margin (OD04768-08) | 10.3 | 14.0 | 3.9 |
| Kidney Margin (OD04340) | 48.0 | 27.2 | 13.5 | Normal Stomach | 34.4 | 25.5 | 10.4 |
| Kidney Ca, Nuclear grade 3 (OD04348) | 21.6 | 14.6 | 6.9 | Gastric Cancer 9060358 | 10.7 | 11.4 | 3.1 |
| Kidney Margin (OD04348) | 43.5 | 28.9 | 12.8 | Stomach Margin 9060359 | 22.2 | 31.4 | 9.3 |
| Kidney Cancer (OD04622-01) | 28.5 | 17.8 | 9.0 | Gastric Cancer 9060395 | 28.3 | 22.7 | 10.6 |
| Kidney Margin (OD04622-03) | 12.6 | 6.5 | 3.8 | Stomach Margin 9060394 | 25.3 | 29.5 | 9.3 |
| Kidney Cancer (OD04450-01) | 25.0 | 12.9 | 11.6 | Gastric Cancer 9060397 | 46.3 | 57.4 | 12.9 |

TABLE QJ-continued

Panel 2D

| Tissue Name | Rel. Exp. (%) Ag2801, Run 162598698 | Rel. Exp. (%) Ag2802, Run 162303857 | Rel. Exp. (%) Ag2833, Run 153834324 | Tissue Name | Rel. Exp. (%) Ag2801, Run 162598698 | Rel. Exp. (%) Ag2802, Run 162303857 | Rel. Exp. (%) Ag2833, Run 153834324 |
|---|---|---|---|---|---|---|---|
| Kidney Margin (OD04450-03) | 42.9 | 27.5 | 12.4 | Stomach Margin 9060396 | 13.6 | 17.4 | 5.6 |
| Kidney Cancer 8120607 | 16.0 | 11.6 | 4.0 | Gastric Cancer 064005 | 48.6 | 50.7 | 22.1 |

TABLE QK

Panel 4D

| Tissue Name | Rel. Exp. (%) Ag2801, Run 162307764 | Rel. Exp. (%) Ag2802, Run 162303864 | Rel. Exp. (%) Ag2833, Run 153834325 | Tissue Name | Rel. Exp. (%) Ag2801, Run 162307764 | Rel. Exp. (%) Ag2802, Run 162303864 | Rel. Exp. (%) Ag2833, Run 153834325 |
|---|---|---|---|---|---|---|---|
| Secondary Th1 act | 19.6 | 16.6 | 23.2 | HUVEC IL-1beta | 9.7 | 3.9 | 6.8 |
| Secondary Th2 act | 23.8 | 27.2 | 23.5 | HUVEC IFN gamma | 12.2 | 14.9 | 22.4 |
| Secondary Tr1 act | 29.1 | 24.0 | 22.2 | HUVEC TNF alpha + IFN gamma | 15.7 | 13.2 | 13.0 |
| Secondary Th1 rest | 11.6 | 6.8 | 9.8 | HUVEC TNF alpha + IL4 | 10.3 | 15.4 | 15.6 |
| Secondary Th2 rest | 10.6 | 8.8 | 12.5 | HUVEC IL-11 | 11.7 | 9.9 | 6.6 |
| Secondary Tr1 rest | 21.2 | 9.4 | 14.4 | Lung Microvascular EC none | 11.0 | 12.2 | 11.0 |
| Primary Th1 act | 40.9 | 38.4 | 25.3 | Lung Microvascular EC TNF alpha + IL-1beta | 13.0 | 12.6 | 13.2 |
| Primary Th2 act | 27.7 | 30.8 | 36.3 | Microvascular Dermal EC none | 22.4 | 19.2 | 15.0 |
| Primary Tr1 act | 53.6 | 44.8 | 43.5 | Microvasular Dermal EC TNF alpha + IL-1beta | 20.9 | 15.5 | 12.8 |
| Primary Th1 rest | 51.8 | 49.3 | 59.5 | Bronchial epithelium TNF alpha + IL1beta | 19.1 | 3.5 | 1.9 |
| Primary Th2 rest | 32.5 | 31.6 | 35.1 | Small airway epithelium none | 3.5 | 6.8 | 6.0 |
| Primary Tr1 rest | 27.9 | 29.5 | 23.3 | Small airway epithelium TNF alpha + IL-1beta | 33.0 | 37.4 | 28.9 |
| CD45RA CD4 lymphocyte act | 16.3 | 14.0 | 21.9 | Coronery artery SMC rest | 11.5 | 14.2 | 13.1 |
| CD45RO CD4 lymphocyte act | 19.9 | 24.5 | 25.5 | Coronery artery SMC TNF alpha + IL-1beta | 5.5 | 6.3 | 8.8 |

TABLE QK-continued

Panel 4D

| Tissue Name | Rel. Exp. (%) Ag2801, Run 162307764 | Rel. Exp. (%) Ag2802, Run 162303864 | Rel. Exp. (%) Ag2833, Run 153834325 | Tissue Name | Rel. Exp. (%) Ag2801, Run 162307764 | Rel. Exp. (%) Ag2802, Run 162303864 | Rel. Exp. (%) Ag2833, Run 153834325 |
|---|---|---|---|---|---|---|---|
| CD8 lymphocyte act | 26.4 | 22.8 | 20.4 | Astrocytes rest | 14.4 | 10.2 | 9.4 |
| Secondary CD8 lymphocyte rest | 22.2 | 20.9 | 15.4 | Astrocytes TNF alpha + IL-1beta | 8.4 | 8.4 | 9.1 |
| Secondary CD8 lymphocyte act | 16.6 | 15.4 | 15.5 | KU-812 (Basophil) rest | 8.3 | 9.0 | 8.9 |
| CD4 lymphocyte none | 12.2 | 7.4 | 12.3 | KU-812 (Basophil) PMA/ionomycin | 26.6 | 20.0 | 18.0 |
| 2ry Th1/Th2/Tr1_ anti-CD95 CH11 | 25.9 | 15.7 | 23.5 | CCD1106 (Keratinocytes) none | 13.5 | 8.9 | 7.4 |
| LAK cells rest | 16.5 | 18.6 | 18.2 | CCD1106 (Keratinocytes) TNF alpha + IL-1beta | 13.7 | 1.7 | 1.4 |
| LAK cells IL-2 | 22.1 | 20.4 | 22.8 | Liver cirrhosis | 5.0 | 1.7 | 3.1 |
| LAK cells IL-2 + IL-12 | 21.9 | 17.2 | 17.6 | Lupus kidney | 5.8 | 1.5 | 3.5 |
| LAK cells IL-2 + IFN gamma | 45.4 | 29.9 | 30.1 | NCI-H292 none | 72.2 | 70.2 | 56.6 |
| LAK cells IL-2 + IL-18 | 26.2 | 28.7 | 26.8 | NCI-H292 IL-4 | 100.0 | 95.9 | 100.0 |
| LAK cells PMA/ionomycin | 7.4 | 6.7 | 8.7 | NCI-H292 IL-9 | 62.4 | 88.3 | 87.1 |
| NK Cells IL-2 rest | 13.5 | 15.0 | 18.4 | NCI-H292 IL-13 | 36.1 | 48.0 | 48.3 |
| Two Way MLR 3 day | 21.6 | 13.8 | 20.2 | NCI-H292 IFN gamma | 46.7 | 48.3 | 47.3 |
| Two Way MLR 5 day | 27.0 | 10.4 | 8.9 | HPAEC none | 9.5 | 12.8 | 11.7 |
| Two Way MLR 7 day | 14.0 | 8.1 | 8.4 | HPAEC TNF alpha + IL-1beta | 15.5 | 12.5 | 15.3 |
| PBMC rest | 9.3 | 7.1 | 7.7 | Lung fibroblast none | 14.1 | 15.9 | 15.0 |
| PBMC PWM | 94.0 | 41.8 | 44.1 | Lung fibroblast TNF alpha + IL-1beta | 9.3 | 12.3 | 11.6 |
| PBMC PHA-L | 31.2 | 16.2 | 22.2 | Lung fibroblast IL-4 | 53.6 | 50.0 | 38.7 |
| Ramos (B cell) none | 13.7 | 13.4 | 13.3 | Lung fibroblast IL-9 | 21.5 | 27.7 | 23.8 |
| Ramos (B cell) ionomycin | 65.5 | 72.7 | 51.1 | Lung fibroblast IL-13 | 22.1 | 24.5 | 25.0 |
| B lymphocytes PWM | 73.7 | 74.2 | 72.2 | Lung fibroblast IFN gamma | 31.6 | 44.4 | 28.5 |
| B lymphocytes CD40L and IL-4 | 73.7 | 100.0 | 64.6 | Dermal fibroblast CCD1070 rest | 33.4 | 26.2 | 30.4 |
| EOL-1 dbcAMP | 15.9 | 11.6 | 15.8 | Dermal fibroblast CCD1070 TNF alpha | 54.3 | 64.6 | 76.8 |
| EOL-1 dbcAMP | 14.7 | 15.0 | 21.2 | Dermal fibroblast | 13.5 | 15.9 | 15.4 |

TABLE QK-continued

Panel 4D

| Tissue Name | Rel. Exp. (%) Ag2801, Run 162307764 | Rel. Exp. (%) Ag2802, Run 162303864 | Rel. Exp. (%) Ag2833, Run 153834325 | Tissue Name | Rel. Exp. (%) Ag2801, Run 162307764 | Rel. Exp. (%) Ag2802, Run 162303864 | Rel. Exp. (%) Ag2833, Run 153834325 |
|---|---|---|---|---|---|---|---|
| PMA/ionomycin | | | | CCD1070 IL-1beta | | | |
| Dendritic cells none | 15.6 | 13.8 | 13.1 | Dermal fibroblast IFN gamma | 7.3 | 9.0 | 9.0 |
| Dendritic cells LPS | 6.6 | 6.5 | 6.1 | Dermal fibroblast IL-4 | 21.3 | 23.7 | 25.7 |
| Dendritic cells anti-CD40 | 15.6 | 11.4 | 10.7 | IBD Colitis 2 | 1.8 | 1.3 | 3.1 |
| Monocytes rest | 25.9 | 25.3 | 21.9 | IBD Crohn's | 3.2 | 1.6 | 3.9 |
| Monocytes LPS | 20.3 | 16.5 | 12.2 | Colon | 24.1 | 20.9 | 21.3 |
| Macrophages rest | 16.5 | 15.5 | 14.9 | Lung | 12.9 | 15.3 | 12.2 |
| Macrophages LPS | 6.3 | 4.6 | 6.6 | Thymus | 26.4 | 31.4 | 28.9 |
| HUVEC none | 14.4 | 14.7 | 15.4 | Kidney | 25.3 | 29.5 | 39.2 |
| HUVEC starved | 27.9 | 24.5 | 30.6 | | | | |

CNS_neurodegeneration_v1.0 Summary: Ag2801/Ag2802 Two runs with the same probe and primer set produce consistent results, with highest expression in both runs in the temporal cortex of a patient with Alzheimer's disease (CTs=26–29). While the expression profile does not show a difference in the expression of this gene between the postmortem brains of Alzheimer's patients and control patients, this panel confirms the expression of this gene at moderate to high levels in the brain in an independent group of patients. Please see Panel 1.3D for discussion of utility in the central nervous system.

Please note that data from a third experiment with the probe and primer set Ag2833 shows low/undetectable expression (CTs>35) in all the samples in the panel.

Panel 1 Summary: Ag156 This gene is ubiquitously expressed at moderate to high levels in all the tissue samples on this panel, with highest expression in a breast cancer cell line MCF-7 (CT=24.45). This widespread expression suggests that the gene product may be required for survival and proliferation of almost all cell types.

This gene is highly expressed in a variety of metabolic tissues including pancreas, adrenal, thyroid, pituitary, heart, skeletal muscle, and adult and fetal liver. This expression profile suggests that this gene product may be important for the pathogenesis, diagnosis, and/or treatment of metabolic disease, including obesity and Types 1 and 2 diabetes.

This gene is also widely expressed at high levels among tissues originating in the central nervous system. See Panel 1.3d for utility of this gene in central nervous system.

Panel 1.2 Summary: Ag892 is ubiquitously expressed at high levels in almost all tissues in this panel, with highest expression in skeletal muscle (CT=22.9). This widespread experssion suggests that expression of this gene is required for survival and proliferation of almost all cell types. This conclusion is reinforced by the expression seen in Panels 1 and 1.3D.

This gene is highly expressed (CT values=23–26) in a variety of metabolic tissues including pancreas, adrenal, thyroid, pituitary, heart, skeletal muscle, and adult and fetal liver. Thus, this gene product may be important for the pathogenesis, diagnosis, and/or treatment of metabolic disease including obesity, and Types 1 and 2 diabetes.

This gene is also widely expressed at high levels among tissues originating in the central nervous system. See Panel 1.3d for utility of this gene in central nervous system.

Panel 1.3D Summary: Ag2801/2802/2833 Three experiments with three different probe and primer sets produce results that are in excellent agreement, with highest expression in the cerebral cortesx and fetal skeletal muscle (CTs=26.5–28.5). This gene is moderately expressed in a variety of metabolic tissues including pancreas, adrenal, thyroid, pituitary, adult and fetal heart, adult and fetal skeletal muscle, adult and fetal liver, and adipose. This widespread expression in tissues with metabolic function suggests that this gene product may be important for the pathogenesis, diagnosis, and/or treatment of metabolic disease, including obesity and Types 1 and 2 diabetes.

This gene is a homolog of SEC6 and is expressed at moderate to high levels in all CNS regions examined. SEC6 plays a role in synaptic plasticity, making this a drug target for any clinical condition in which increased synaptogenesis is desireable (head trauma, stroke, Alzheimer's, Parkinson's, or Huntington's disease, spinocerebellar ataxia, or cerebral ischemia). Thus, increasing levels of this protein may enhance the regenerative capabilities of the CNS.

Sec6, an essential component of the mammalian brain exocyst complex, is believed to function in synapse formation and synaptic plasticity. During neuronal development, the expression of the Sec6 gene correlates temporally with neurite outgrowth and synaptogenesis. It was recently shown that the 5'-untranslated region of the murine Sec6 gene is encoded by two exons that are separated by a 1560-bp intron. Primer extension analysis demonstrates that Sec6 gene transcription is initiated from a unique site. The Sec6 promoter is embedded in a CpG island and lacks canonical TATA or CAAT boxes. Sequence analysis of the 5'-flanking region and the first intron reveals the presence of a number of binding sites for transcription factors AP-1, AP-2, AP-4, ATF, C/EBPbeta, GATA-1, Oct 1, SP1, STAT, and NRSF. Transfection experiments using Sec6-luciferase fusion genes demonstrate that the 5'-flanking sequence functions as a strong promoter in neuronal but not in nonneuronal cells. Deletion analysis reveals the presence of a core promoter between nucleotide position −139 and +53, and two enhancer and four silencer elements within the 5'-flanking region and the first intron sequence. These results indicate that neuronal expression of the Sec6 gene involves a relatively specific core promoter and interplay between multiple positive and negative regulatory elements. See Chin, L. S., et al., *Brain Res Mol Brain Res,* 2000 Jun. 23; 79(1–2):127–37.

The molecules that specify domains on the neuronal plasma membrane for the delivery and accumulation of vesicles during neurite outgrowth and synapse formation are unknown. The sec6/8 complex, a set of proteins that specifies vesicle targeting sites in yeast and epithelial cells, was found to play a role in neuronal membrane trafficking. This complex was found in layers of developing rat brain undergoing synaptogenesis. In cultured hippocampal neurons, the sec6/8 complex was present in regions of ongoing membrane addition: the tips of growing neurites, filopodia, and growth cones. In young axons, the sec6/8 complex was also confined to periodic domains of the plasma membrane. The distribution of synaptotagmin, synapsin1, sec6, and FM1-43 labeling in cultured neurons suggested that the plasma membrane localization of the sec6/8 complex preceded the arrival of synaptic markers and was downregulated in mature synapses. Therefore, it is likely that the sec6/8 complex specifies sites for targeting vesicles at domains of neurite outgrowth and potential active zones during synaptogenesis. See Hazuka, C. D., et al., *J Neurosci,* 1999 Feb. 15; 19(4):1324–34.

Panel 2D Summary: Ag2801/2802/2833 There is good concordance between three runs with three different probe and primer sets. There is increased expression in samples from ovarian, bladder, and uterine cancers, an ocular melanoma metastasized to liver and a colon cancer metastasized to liver when compared to the normal adjacent tissues. Hence, expression of this gene can be used as a diagnostic marker for these cancers.

Panel 4D Summary: Ag2801/2802/2833 This gene encodes a Sec6-like protein and is expressed at high levels (CT=25–30) in numerous immune cell types and tissues on this panel. Small molecule antagonists that block the function of the Sec6-like protein encoded by this gene may be useful as therapeutics that reduce or eliminate the symptoms of patients suffering from autoimmune and inflammatory diseases such as asthma, allergies, inflammatory bowel disease, lupus erythematosus, and rheumatoid arthritis.

R. NOV11

CG58606-01/SC111743377_A: Steroid Dehydrogenase

Expression of gene CG58606-01 was assessed using the primer-probe sets Ag2248 and Ag2548, described in Tables RA and RB. Results of the RTQ-PCR runs are shown in Tables RC, RD, RE, RF, RG, RH, RI, and RJ.

TABLE RA

Probe Name Ag2248

| Primers | Sequences | Length | Start Position | SEQ ID NO |
|---|---|---|---|---|
| Forward | 5'-agcctacgctgaagagttagc-3' | 21 | 253 | 247 |
| Probe | TET-5'-aagccgaggtctcaatataatcctga-3'-TAMRA | 26 | 274 | 248 |
| Reverse | 5'-acctgcaacttctcctcgtt-3' | 20 | 308 | 249 |

TABLE RB

Probe Name Ag2548

| Primers | Sequences | Length | Start Position | SEQ ID NO |
|---|---|---|---|---|
| Forward | 5'-gacgttggcatcttggtaaata-3' | 22 | 440 | 250 |
| Probe | TET-5'-cgcagtatttcactcagctgtccgag-3'-TAMRA | 26 | 486 | 251 |
| Reverse | 5'-ttatgatgtcccagagcttgtc-3' | 22 | 512 | 252 |

TABLE RC

CNS_neurodegeneration_v1.0

| Tissue Name | Rel. Exp. (%) Ag2248, Run 207928610 | Rel. Exp. (%) Ag2548, Run 208300028 | Tissue Name | Rel. Exp. (%) Ag2248, Run 207928610 | Rel. Exp. (%) Ag2548, Run 208300028 |
|---|---|---|---|---|---|
| AD 1 Hippo | 20.2 | 14.7 | Control (Path) 3 Temporal Ctx | 4.4 | 4.1 |
| AD 2 Hippo | 27.2 | 46.7 | Control (Path) 4 Temporal Ctx | 37.6 | 37.9 |

TABLE RC-continued

CNS_neurodegeneration_v1.0

| Tissue Name | Rel. Exp. (%) Ag2248, Run 207928610 | Rel. Exp. (%) Ag2548, Run 208300028 | Tissue Name | Rel. Exp. (%) Ag2248, Run 207928610 | Rel. Exp. (%) Ag2548, Run 208300028 |
|---|---|---|---|---|---|
| AD 3 Hippo | 5.6 | 6.9 | AD 1 Occipital Ctx | 11.0 | 20.0 |
| AD 4 Hippo | 10.8 | 11.4 | AD 2 Occipital Ctx (Missing) | 0.0 | 0.0 |
| AD 5 Hippo | 85.3 | 2.6 | AD 3 Occipital Ctx | 6.1 | 6.2 |
| AD 6 Hippo | 69.7 | 50.0 | AD 4 Occipital Ctx | 21.6 | 22.7 |
| Control 2 Hippo | 42.9 | 45.7 | AD 5 Occipital Ctx | 14.0 | 11.8 |
| Control 4 Hippo | 11.3 | 12.5 | AD 5 Occipital Ctx | 47.3 | 49.0 |
| Control (Path) 3 Hippo | 7.6 | 7.2 | Control 1 Occipital Ctx | 1.4 | 1.8 |
| AD 1 Temporal Ctx | 18.2 | 20.4 | Control 2 Occipital Ctx | 81.8 | 83.5 |
| AD 2 Temporal Ctx | 27.4 | 42.6 | Control 3 Occipital Ctx | 13.1 | 15.9 |
| AD 3 Temporal Ctx | 5.5 | 6.8 | Control 4 Occipital Ctx | 6.7 | 6.5 |
| AD 4 Temporal Ctx | 17.4 | 22.5 | Control (Path) 1 Occipital Ctx | 91.4 | 100.0 |
| AD 5 Inf Temporal Ctx | 89.5 | 99.3 | Control (Path) 2 Occipital Ctx | 11.8 | 9.7 |
| AD 5 Sup Temporal Ctx | 34.6 | 50.7 | Control (Path) 3 Occipital Ctx | 1.6 | 2.0 |
| AD 6 Inf Temporal Ctx | 42.9 | 42.0 | Control (Path) 4 Occipital Ctx | 15.5 | 15.1 |
| AD 6 Sup Temporal Ctx | 50.3 | 45.1 | Control 1 Parietal Ctx | 8.1 | 4.6 |
| Control 1 Temporal Ctx | 3.7 | 3.5 | Control 2 Parietal Ctx | 30.1 | 33.4 |
| Control 2 Temporal Ctx | 56.6 | 42.6 | Control 3 Parietal Ctx | 24.0 | 21.9 |
| Control 3 Temporal Ctx | 19.1 | 12.3 | Control (Path) 1 Parietal Ctx | 100.0 | 84.7 |
| Control 3 Temporal Ctx | 7.1 | 8.0 | Control (Path) 2 Parietal Ctx | 26.8 | 20.3 |
| Control (Path) 1 Temporal Ctx | 64.2 | 74.2 | Control (Path) 3 Parietal Ctx | 4.7 | 3.7 |
| Control (Path) 2 Temporal Ctx | 23.5 | 30.1 | Control (Path) 4 Parietal Ctx | 44.4 | 66.4 |

TABLE RD

Panel 1.3D

| Tissue Name | Rel. Exp. (%) Ag2248, Run 159035206 | Rel. Exp. (%) Ag2548, Run 162292266 | Tissue Name | Rel. Exp. (%) Ag2248, Run 159035206 | Rel. Exp. (%) Ag2548, Run 162292266 |
|---|---|---|---|---|---|
| Liver adenocarcinoma | 8.7 | 25.5 | Kidney (fetal) | 5.0 | 14.1 |
| Pancreas | 1.1 | 1.7 | Renal ca. 786-0 | 5.3 | 7.5 |
| Pancreatic ca. CAPAN 2 | 2.2 | 6.3 | Renal ca. A498 | 10.2 | 9.0 |
| Adrenal gland | 6.6 | 6.0 | Renal ca. RXF 393 | 1.5 | 9.0 |
| Thyroid | 9.0 | 19.3 | Renal ca. ACHN | 1.7 | 12.8 |
| Salivary gland | 2.9 | 3.7 | Renal ca. UO-31 | 5.4 | 15.1 |
| Pituitary gland | 19.8 | 16.2 | Renal ca. TK-10 | 1.5 | 6.7 |
| Brain (fetal) | 28.3 | 14.3 | Liver | 1.3 | 0.4 |
| Brain (whole) | 22.7 | 25.2 | Liver (fetal) | 3.1 | 2.3 |
| Brain (amygdala) | 24.7 | 24.3 | Liver ca. (hepatoblast) HepG2 | 8.1 | 18.7 |
| Brain (cerebellum) | 11.6 | 14.6 | Lung | 10.2 | 7.4 |
| Brain (hippocampus) | 100.0 | 45.1 | Lung (fetal) | 9.5 | 12.5 |
| Brain (substantia nigra) | 5.1 | 7.2 | Lung ca. (small cell) LX-1 | 11.0 | 16.0 |

TABLE RD-continued

Panel 1.3D

| Tissue Name | Rel. Exp. (%) Ag2248, Run 159035206 | Rel. Exp. (%) Ag2548, Run 162292266 | Tissue Name | Rel. Exp. (%) Ag2248, Run 159035206 | Rel. Exp. (%) Ag2548, Run 162292266 |
|---|---|---|---|---|---|
| Brain (thalamus) | 19.2 | 25.2 | Lung ca. (small cell) NCI-H69 | 7.5 | 6.3 |
| Cerebral Cortex | 44.8 | 100.0 | Lung ca. (s.cell var.) SHP-77 | 42.9 | 73.7 |
| Spinal cord | 4.8 | 14.9 | Lung ca. (large cell)NCI-H460 | 2.7 | 10.1 |
| glio/astro U87-MG | 11.7 | 42.3 | Lung ca. (non-sm. cell) A549 | 1.8 | 4.1 |
| glio/astro U-118-MG | 20.7 | 12.0 | Lung ca. (non-s.cell) NCI-H23 | 11.7 | 28.5 |
| astrocytoma SW1783 | 8.1 | 38.2 | Lung ca. (non-s.cell) HOP-62 | 5.3 | 24.0 |
| neuro*; met SK-N-AS | 14.2 | 6.5 | Lung ca. (non-s.cl) NCI-H522 | 5.0 | 15.1 |
| astrocytoma SF-539 | 3.9 | 15.2 | Lung ca. (squam.) SW 900 | 3.4 | 12.6 |
| astrocytoma SNB-75 | 8.8 | 11.3 | Lung ca. (squam.) NCI-H596 | 1.5 | 1.9 |
| glioma SNB-19 | 4.1 | 20.0 | Mammary gland | 7.5 | 9.6 |
| glioma U251 | 2.5 | 5.8 | Breast ca.* (pl.ef) MCF-7 | 25.3 | 88.9 |
| glioma SF-295 | 3.4 | 24.0 | Breast ca.* (pl.ef) MDA-MB-231 | 21.8 | 6.4 |
| Heart (Fetal) | 9.7 | 35.1 | Breast ca.* (pl. ef) T47D | 13.6 | 29.3 |
| Heart | 3.6 | 11.4 | Breast. ca. BT-549 | 22.1 | 7.4 |
| Skeletal muscle (Fetal) | 8.2 | 44.1 | Breast ca. MDA-N | 5.7 | 11.1 |
| Skeletal muscle | 5.6 | 47.6 | Ovary | 5.4 | 26.6 |
| Bone marrow | 3.2 | 1.7 | Ovarian ca. OVCAR-3 | 2.5 | 4.8 |
| Thymus | 3.5 | 40.6 | Ovarian ca. OVCAR-4 | 0.6 | 3.6 |
| Spleen | 5.4 | 10.9 | Ovarian ca. OVCAR-5 | 3.8 | 13.1 |
| Lymph node | 2.8 | 4.4 | Ovarian ca. OVCAR-8 | 5.9 | 21.2 |
| Colorectal | 1.9 | 9.4 | Ovarian ca. IGROV-1 | 1.4 | 3.1 |
| Stomach | 2.2 | 2.7 | Ovarian ca. (ascites) SK-OV-3 | 5.3 | 13.1 |
| Small intestine | 5.0 | 7.3 | Uterus | 3.9 | 6.0 |
| Colon ca. SW480 | 6.0 | 12.6 | Placenta | 5.2 | 8.8 |
| Colon ca.* SW620 (SW480 met) | 4.7 | 11.1 | Prostate | 2.0 | 6.7 |
| Colon ca. HT29 | 2.6 | 7.1 | Prostate ca.* (bone met) PC-3 | 5.4 | 9.7 |
| Colon ca. HCT-116 | 9.5 | 22.4 | Testis | 7.7 | 24.8 |
| Colon ca. CaCo-2 | 6.7 | 18.0 | Melanoma Hs688(A).T | 3.3 | 7.7 |
| CC Well to Mod Diff (ODO3866) | 4.8 | 13.2 | Melanoma* (met) Hs688(B).T | 1.2 | 6.9 |
| Colon ca. HCC-2998 | 17.2 | 10.2 | Melanoma UACC-62 | 1.5 | 5.6 |
| Gastric ca. (liver met) NCI-N87 | 10.8 | 14.7 | Melanoma M14 | 4.3 | 8.1 |
| Bladder | 2.6 | 11.0 | Melanoma LOX IMVI | 4.8 | 2.9 |
| Trachea | 6.4 | 13.8 | Melanoma* (met) SK-MEL-5 | 6.9 | 10.4 |
| Kidney | 1.7 | 14.1 | Adipose | 2.3 | 6.0 |

TABLE RE

Panel 2D

| Tissue Name | Rel. Exp. (%) Ag2248, Run 159035545 | Rel. Exp. (%) Ag2548, Run 162326203 | Tissue Name | Rel. Exp. (%) Ag2248, Run 159035545 | Rel. Exp. (%) Ag2548, Run 162326203 |
|---|---|---|---|---|---|
| Normal Colon | 49.3 | 39.5 | Kidney Margin 8120608 | 4.7 | 6.3 |
| CC Well to Mod Diff (ODO3866) | 14.2 | 10.7 | Kidney Cancer 8120613 | 7.1 | 14.0 |
| CC Margin (ODO3866) | 10.7 | 8.9 | Kidney Margin 8120614 | 8.8 | 10.7 |
| CC Gr.2 rectosigmoid (ODO3868) | 6.6 | 5.9 | Kidney Cancer 9010320 | 10.9 | 13.7 |
| CC Margin (ODO3868) | 5.8 | 6.9 | Kidney Margin 9010321 | 9.7 | 18.4 |
| CC Mod Diff (ODO3920) | 38.4 | 21.5 | Normal Uterus | 6.5 | 8.0 |
| CC Margin (ODO3920) | 14.5 | 9.5 | Uterine Cancer 064011 | 42.9 | 24.1 |
| CC Gr.2 ascend colon (ODO3921) | 25.5 | 15.8 | Normal Thyroid | 40.3 | 31.0 |
| CC Margin (ODO3921) | 7.7 | 5.9 | Thyroid Cancer | 21.0 | 21.0 |
| CC from Partial Hepatectomy (ODO4309) Mets | 32.5 | 28.5 | Thyroid Cancer A302152 | 21.9 | 18.4 |
| Liver Margin (ODO4309) | 12.2 | 9.0 | Thyroid Margin A302153 | 37.9 | 39.0 |
| Colon mets to lung (OD04451-01) | 15.6 | 8.5 | Normal Breast | 18.9 | 23.8 |
| Lung Margin (OD04451-02) | 12.6 | 9.2 | Breast Cancer | 14.2 | 20.2 |
| Normal Prostate 6546-1 | 6.6 | 57.4 | Breast Cancer (OD04590-01) | 100.0 | 100.0 |
| Prostate Cancer (OD04410) | 40.3 | 31.0 | Breast Cancer Mets (OD04590-03) | 87.1 | 90.1 |
| Prostate Margin (OD04410) | 27.0 | 21.8 | Breast Cancer Metastasis | 37.6 | 37.4 |
| Prostate Cancer (OD04720-01) | 28.5 | 18.3 | Breast Cancer | 14.6 | 14.1 |
| Prostate Margin (OD04720-02) | 35.8 | 25.0 | Breast Cancer | 27.4 | 28.9 |
| Normal Lung | 56.6 | 39.0 | Breast Cancer 9100266 | 46.7 | 41.5 |
| Lung Met to Muscle (ODO4286) | 33.4 | 22.7 | Breast Margin 9100265 | 15.5 | 16.7 |
| Muscle Margin (ODO4286) | 22.1 | 12.3 | Breast Cancer A209073 | 42.3 | 42.9 |
| Lung Malignant Cancer (OD03126) | 33.4 | 27.0 | Breast Margin A2090734 | 21.3 | 17.2 |
| Lung Margin (OD03126) | 27.5 | 21.9 | Normal Liver | 5.4 | 4.6 |
| Lung Cancer (OD04404) | 13.3 | 14.9 | Liver Cancer | 3.8 | 3.0 |
| Lung Margin (OD04404) | 12.0 | 11.6 | Liver Cancer 1025 | 4.2 | 2.3 |
| Lung Cancer (OD04565) | 14.1 | 14.3 | Liver Cancer 1026 | 3.0 | 1.3 |
| Lung Margin (OD04565) | 6.9 | 11.0 | Liver Cancer 6004-T | 3.6 | 1.6 |
| Lung Cancer (OD04237-01) | 95.9 | 82.4 | Liver Tissue 6004-N | 11.7 | 9.0 |
| Lung Margin (OD04237-02) | 15.5 | 13.7 | Liver Cancer 6005-T | 2.2 | 2.9 |
| Ocular Mel Met to Liver (ODO4310) | 27.4 | 19.9 | Liver Tissue 6005-N | 4.4 | 3.8 |
| Liver Margin (ODO4310) | 5.1 | 3.4 | Normal Bladder | 26.6 | 16.0 |
| Melanoma Metastasis | 24.8 | 18.8 | Bladder Cancer | 5.0 | 3.0 |
| Lung Margin (OD04321) | 23.8 | 20.0 | Bladder Cancer | 17.1 | 8.8 |
| Normal Kidney | 40.1 | 48.0 | Bladder Cancer (OD04718-01) | 22.2 | 15.5 |

TABLE RE-continued

Panel 2D

| Tissue Name | Rel. Exp. (%) Ag2248, Run 159035545 | Rel. Exp. (%) Ag2548, Run 162326203 | Tissue Name | Rel. Exp. (%) Ag2248, Run 159035545 | Rel. Exp. (%) Ag2548, Run 162326203 |
|---|---|---|---|---|---|
| Kidney Ca, Nuclear grade 2 (OD04338) | 30.6 | 41.8 | Bladder Normal Adjacent (OD04718-03) | 21.2 | 15.6 |
| Kidney Margin (OD04338) | 16.4 | 15.9 | Normal Ovary | 12.6 | 8.8 |
| Kidney Ca Nuclear grade 1/2 (OD04339) | 11.3 | 15.8 | Ovarian Cancer | 21.6 | 16.5 |
| Kidney Margin (OD04339) | 19.6 | 24.5 | Ovarian Cancer (OD04768-07) | 40.1 | 33.9 |
| Kidney Ca, Clear cell type (OD04340) | 20.4 | 30.8 | Ovary Margin (OD04768-08) | 11.3 | 4.0 |
| Kidney Margin (OD04340) | 18.4 | 13.9 | Normal Stomach | 12.2 | 8.8 |
| Kidney Ca, Nuclear grade 3 (OD04348) | 13.3 | 6.1 | Gastric Cancer 9060358 | 5.0 | 3.0 |
| Kidney Margin (OD04348) | 21.2 | 19.3 | Stomach Margin 9060359 | 16.0 | 11.0 |
| Kidney Cancer (OD04622-01) | 19.3 | 19.2 | Gastric Cancer 9060395 | 16.3 | 12.6 |
| Kidney Margin (OD04622-03) | 4.4 | 5.3 | Stomach Margin 9060394 | 13.9 | 10.6 |
| Kidney Cancer (OD04450-01) | 23.8 | 27.0 | Gastric Cancer 9060397 | 24.0 | 12.1 |
| Kidney Margin (OD04450-03) | 15.2 | 20.0 | Stomach Margin 9060396 | 6.4 | 7.1 |
| Kidney Cancer 8120607 | 5.6 | 4.2 | Gastric Cancer 064005 | 37.1 | 20.3 |

TABLE RF

Panel 3D

| Tissue Name | Rel. Exp. (%) Ag2548, Run 164886193 | Tissue Name | Rel. Exp. (%) Ag2548, Run 164886193 |
|---|---|---|---|
| Daoy-Medulloblastoma | 8.7 | Ca Ski-Cervical epidermoid carcinoma (metastasis) | 10.6 |
| TE671-Medulloblastoma | 10.7 | ES-2-Ovarian clear cell carcinoma | 11.3 |
| D283 Med-Medulloblastoma | 40.6 | Ramos-Stimulated with PMA/ionomycin 6 h | 2.0 |
| PFSK-1-Primitive Neuroectodermal | 9.0 | Ramos-Stimulated with PMA/ionomycin 14 h | 8.8 |
| XF-498-CNS | 9.3 | MEG-01-Chronic myelogenous leukemia (megokaryoblast) | 11.5 |
| SNB-78-Glioma | 12.9 | Raji-Burkitt's lymphoma | 4.5 |
| SF-268-Glioblastoma | 9.4 | Daudi-Burkitt's lymphoma | 12.0 |
| T98G-Glioblastoma | 13.7 | U266-B-cell plasmacytoma | 28.1 |
| SK-N-SH-Neuroblastoma (metastasis) | 14.9 | CA46-Burkitt's lymphoma | 9.2 |
| SF-295-Glioblastoma | 9.9 | RL-non-Hodgkin's B-cell lymphoma | 2.2 |
| Cerebellum | 21.5 | JM1-pre-B-cell lymphoma | 6.3 |
| Cerebellum | 6.0 | Jurkat-T cell leukemia | 18.7 |
| NCI-H292-Mucoepidermoid lung carcinoma | 25.7 | TF-1-Erythroleukemia | 9.7 |
| DMS-114-Small cell lung cancer | 16.3 | HUT 78-T-cell lymphoma | 17.1 |
| DMS-79-Small cell lung cancer | 100.0 | U937-Histiocytic lymphoma | 11.2 |
| NCI-H146-Small cell lung cancer | 20.9 | KU-812-Myelogenous leukemia | 5.3 |
| NCI-H526-Small cell lung cancer | 36.6 | 769-P-Clear cell renal carcinoma | 6.2 |

TABLE RF-continued

Panel 3D

| Tissue Name | Rel. Exp. (%) Ag2548, Run 164886193 | Tissue Name | Rel. Exp. (%) Ag2548, Run 164886193 |
|---|---|---|---|
| NCI-N417-Small cell lung cancer | 9.7 | Caki-2-Clear cell renal carcinoma | 8.1 |
| NCI-H82-Small cell lung cancer | 14.2 | SW 839-Clear cell renal carcinoma | 2.9 |
| NCI-H157-Squamous cell lung cancer (metastasis) | 19.6 | G401-Wilms' tumor | 8.8 |
| NCI-H1155-Large cell lung cancer | 34.6 | Hs766T-Pancreatic carcinoma (LN metastasis) | 13.3 |
| NCI-H1299-Large cell lung cancer | 19.9 | CAPAN-1-Pancreatic adenocarcinoma (liver metastasis) | 7.7 |
| NCI-H727-Lung carcinoid | 14.2 | SU86.86-Pancreatic carcinoma (liver metastasis) | 10.0 |
| NCI-UMC-11-Lung carcinoid | 12.6 | BxPC-3-Pancreatic adenocarcinoma | 4.3 |
| LX-1-Small cell lung cancer | 20.0 | HPAC- Pancreatic adenocarcinoma | 6.6 |
| Colo-205-Colon cancer | 15.8 | MIA PaCa-2-Pancreatic carcinoma | 4.6 |
| KM12-Colon cancer | 9.3 | CFPAC-1-Pancreatic ductal adenocarcinoma | 19.5 |
| KM20L2-Colon cancer | 3.0 | PANC-1-Pancreatic epithelioid ductal carcinoma | 9.5 |
| NCI-H716-Colon cancer | 19.1 | T24-Bladder carcinma (transitional cell) | 9.9 |
| SW-48-Colon adenocarcinoma | 7.9 | 5637-Bladder carcinoma | 4.7 |
| SW1116-Colon adenocarcinoma | 7.4 | HT-1197-Bladder carcinoma | 6.1 |
| LS 174T-Colon adenocarcinoma | 4.6 | UM-UC-3-Bladder carcinma (transitional cell) | 2.8 |
| SW-948-Colon adenocarcinoma | 1.1 | A204-Rhabdomyosarcoma | 3.4 |
| SW-480-Colon adenocarcinoma | 2.7 | HT-1080-Fibrosarcoma | 10.7 |
| NCI-SNU-5-Gastric carcinoma | 9.3 | MG-63-Osteosarcoma | 1.3 |
| KATO III-Gastric carcinoma | 24.0 | SK-LMS-1-Leiomyosarcoma (vulva) | 9.5 |
| NCI-SNU-16-Gastric carcinoma | 9.5 | SJRH30-Rhabdomyosarcoma (met to bone marrow) | 10.2 |
| NCI-SNU-1-Gastric carcinoma | 12.2 | A431-Epidermoid carcinoma | 5.0 |
| RF-1-Gastric adenocarcinoma | 5.1 | WM266-4-Melanoma | 10.5 |
| RF-48-Gastric adenocarcinoma | 8.1 | DU 145-Prostate carcinoma (brain metastasis) | 0.0 |
| MKN-45-Gastric carcinoma | 5.3 | MDA-MB-468-Breast adenocarcinoma | 20.7 |
| NCI-N87-Gastric carcinoma | 7.4 | SCC-4-Squamous cell carcinoma of tongue | 0.0 |
| OVCAR-5-Ovarian carcinoma | 2.7 | SCC-9-Squamous cell carcinoma of tongue | 0.0 |
| RL95-2-Uterine carcinoma | 3.8 | SCC-15-Squamous cell carcinoma of tongue | 0.0 |
| HelaS3-Cervical adenocarcinoma | 10.7 | CAL 27-Squamous cell carcinoma of tongue | 5.5 |

TABLE RG

Panel 4D

| Tissue Name | Rel. Exp. (%) Ag2248, Run 159034717 | Tissue Name | Rel. Exp. (%) Ag2248, Run 159034717 |
|---|---|---|---|
| Secondary Th1 act | 27.2 | HUVEC IL-1beta | 8.4 |
| Secondary Th2 act | 33.4 | HUVEC IFN gamma | 14.4 |
| Secondary Tr1 act | 37.4 | HUVEC TNF alpha + IFN gamma | 7.4 |
| Secondary Th1 rest | 11.7 | HUVEC TNF alpha + IL4 | 6.6 |

TABLE RG-continued

Panel 4D

| Tissue Name | Rel. Exp. (%) Ag2248, Run 159034717 | Tissue Name | Rel. Exp. (%) Ag2248, Run 159034717 |
|---|---|---|---|
| Secondary Th2 rest | 10.4 | HUVEC IL-11 | 11.8 |
| Secondary Tr1 rest | 12.5 | Lung Microvascular EC none | 9.9 |
| Primary Th1 act | 28.5 | Lung Microvascular EC TNF alpha + IL-1beta | 18.2 |
| Primary Th2 act | 29.3 | Microvascular Dermal EC none | 28.9 |
| Primary Tr1 act | 29.3 | Microvascular Dermal EC TNF alpha + IL-1beta | 20.2 |
| Primary Th1 rest | 62.4 | Bronchial epithelium TNF alpha + IL1beta | 20.7 |
| Primary Th2 rest | 39.8 | Small airway epithelium none | 6.9 |
| Primary Tr1 rest | 15.3 | Small airway epithelium TNF alpha + IL-1beta | 40.3 |
| CD45RA CD4 lymphocyte act | 18.6 | Coronery artery SMC rest | 15.4 |
| CD45RO CD4 lymphocyte act | 20.9 | Coronery artery SMC TNF alpha + IL-1beta | 6.8 |
| CD8 lymphocyte act | 14.7 | Astrocytes rest | 20.0 |
| Secondary CD8 lymphocyte rest | 11.9 | Astrocytes TNF alpha + IL-1beta | 15.8 |
| Secondary CD8 lymphocyte act | 19.9 | KU-812 (Basophil) rest | 8.1 |
| CD4 lymphocyte none | 8.2 | KU-812 (Basophil) PMA/ionomycin | 20.2 |
| 2ry Th1/Th2/Tr1_anti-CD95 CH11 | 17.4 | CCD1106 (Keratinocytes) none | 11.5 |
| LAK cells rest | 19.2 | CCD1106 (Keratinocytes) TNF alpha + IL-1beta | 5.3 |
| LAK cells IL-2 | 18.2 | Liver cirrhosis | 2.4 |
| LAK cells IL-2 + IL-12 | 11.0 | Lupus kidney | 1.8 |
| LAK cells IL-2 + IFN gamma | 19.5 | NCI-H292 none | 39.5 |
| LAK cells IL-2 + IL-18 | 17.7 | NCI-H292 IL-4 | 38.2 |
| LAK cells PMA/ionomycin | 3.6 | NCI-H292 IL-9 | 40.1 |
| NK Cells IL-2 rest | 11.0 | NCI-H292 IL-13 | 18.2 |
| Two Way MLR 3 day | 19.2 | NCI-H292 IFN gamma | 14.7 |
| Two Way MLR 5 day | 8.9 | HPAEC none | 19.2 |
| Two Way MLR 7 day | 6.7 | HPAEC TNF alpha + IL-1beta | 28.5 |
| PBMC rest | 5.8 | Lung fibroblast none | 17.4 |
| PBMC PWM | 40.6 | Lung fibroblast TNF alpha + IL-1 beta | 17.1 |
| PBMC PHA-L | 25.9 | Lung fibroblast IL-4 | 30.4 |
| Ramos (B cell) none | 26.6 | Lung fibroblast IL-9 | 20.2 |
| Ramos (B cell) ionomycin | 100.0 | Lung fibroblast IL-13 | 16.3 |
| B lymphocytes PWM | 35.6 | Lung fibroblast IFN gamma | 28.1 |
| B lymphocytes CD40L and IL-4 | 29.7 | Dermal fibroblast CCD1070 rest | 32.3 |
| EOL-1 dbcAMP | 10.5 | Dermal fibroblast CCD1070 TNF alpha | 57.0 |
| EOL-1 dbcAMP PMA/ionomycin | 7.5 | Dermal fibroblast CCD1070 IL-1 beta | 15.3 |
| Dendritic cells none | 11.6 | Dermal fibroblast IFN gamma | 12.1 |
| Dendritic cells LPS | 7.7 | Dermal fibroblast IL-4 | 20.3 |
| Dendritic cells anti-CD40 | 9.6 | IBD Colitis 2 | 2.3 |
| Monocytes rest | 12.6 | IBD Crohn's | 2.6 |
| Monocytes LPS | 21.0 | Colon | 11.5 |
| Macrophages rest | 24.5 | Lung | 16.2 |
| Macrophages LPS | 14.8 | Thymus | 38.7 |
| HUVEC none | 25.9 | Kidney | 71.2 |
| HUVEC starved | 40.9 | | |

TABLE RH

Panel 5 Islet

| Tissue Name | Rel. Exp. (%) Ag2248, Run 233070521 | Tissue Name | Rel. Exp. (%) Ag2248, Run 233070521 |
|---|---|---|---|
| 97457_Patient-02go_adipose | 23.7 | 94709_Donor 2 AM - A_adipose | 10.5 |
| 97476_Patient-07sk_skeletal muscle | 12.3 | 94710_Donor 2 AM - B_adipose | 5.0 |

TABLE RH-continued

Panel 5 Islet

| Tissue Name | Rel. Exp. (%) Ag2248, Run 233070521 | Tissue Name | Rel. Exp. (%) Ag2248, Run 233070521 |
|---|---|---|---|
| 97477_Patient-07ut_uterus | 18.9 | 94711_Donor 2 AM - C_adipose | 5.3 |
| 97478_Patient-07pl_placenta | 35.6 | 94712_Donor 2 AD - A_adipose | 14.5 |
| 99167_Bayer Patient 1 | 25.0 | 94713_Donor 2 AD - B_adipose | 25.2 |
| 97482_Patient-08ut_uterus | 23.2 | 94714_Donor 2 AD - C_adipose | 18.7 |
| 97483_Patient-08pl_placenta | 25.5 | 94742_Donor 3 U - A_Mesenchymal Stem Cells | 7.4 |
| 97486_Patient-09sk_skeletal muscle | 0.7 | 94743_Donor 3 U - B_Mesenchymal Stem Cells | 11.2 |
| 97487_Patient-09ut_uterus | 23.0 | 94730_Donor 3 AM - A_adipose | 14.6 |
| 97488_Patient-09pl_placenta | 15.3 | 94731_Donor 3 AM - B_adipose | 4.5 |
| 97492_Patient-10ut_uterus | 15.1 | 94732_Donor 3 AM - C_adipose | 10.5 |
| 97493_Patient-10pl_placenta | 52.9 | 94733_Donor 3 AD - A_adipose | 40.1 |
| 97495_Patient-11go_adipose | 9.1 | 94734_Donor 3 AD - B_adipose | 16.0 |
| 97496_Patient-11sk_skeletal muscle | 10.2 | 94735_Donor 3 AD - C_adipose | 14.0 |
| 97497_Patient-11ut_uterus | 21.8 | 77138_Liver_HepG2untreated | 100.0 |
| 97498_Patient-11pl_placenta | 36.3 | 73556_Heart_Cardiac stromal cells (primary) | 9.5 |
| 97500_Patient-12go_adipose | 21.0 | 81735_Small Intestine | 8.7 |
| 97501_Patient-12sk_skeletal muscle | 35.4 | 72409_Kidney_Proximal Convoluted Tubule | 16.7 |
| 97502_Patient-12ut_uterus | 15.5 | 82685_Small intestine_Duodenum | 5.1 |
| 97503_Patient-12pl_placenta | 9.5 | 90650_Adrenal_Adrenocortical adenoma | 18.0 |
| 94721_Donor 2 U - A_Mesenchymal Stem Cells | 8.3 | 72410_Kidney_HRCE | 42.0 |
| 94722_Donor 2 U - B_Mesenchymal Stem Cells | 8.3 | 72411_Kidney_HRE | 27.0 |
| 94723_Donor 2 U - C_Mesenchymal Stem Cells | 20.4 | 73139_Uterus_Uterine smooth muscle cells | 41.5 |

TABLE RI

Panel 5D

| Tissue Name | Rel. Exp. (%) Ag2248, Run 166667616 | Tissue Name | Rel. Exp. (%) Ag2248, Run 166667616 |
|---|---|---|---|
| 97457_Patient-02go_adipose | 44.1 | 94709_Donor 2 AM - A_adipose | 24.3 |
| 97476_Patient-07sk_skeletal muscle | 13.6 | 94710_Donor 2 AM - B_adipose | 7.0 |
| 97477_Patient-07ut_uterus | 42.0 | 94711_Donor 2 AM - C_adipose | 3.1 |
| 97478_Patient-07pl_placenta | 64.6 | 94712_Donor 2 AD - A_adipose | 13.9 |
| 97481_Patient-08sk_skeletal muscle | 29.7 | 94713_Donor 2 AD - B_adipose | 39.2 |
| 97482_Patient-08ut_uterus | 19.5 | 94714_Donor 2 AD - C_adipose | 35.4 |
| 97483_Patient-08pl_placenta | 42.0 | 94742_Donor 3 U - A_Mesenchymal Stem Cells | 17.2 |
| 97486_Patient-09sk_skeletal muscle | 7.3 | 94743_Donor 3 U - B_Mesenchymal Stem Cells | 6.4 |
| 97487_Patient-09ut_uterus | 26.2 | 94730_Donor 3 AM - A_adipose | 10.0 |
| 97488_Patient-09pl_placenta | 31.0 | 94731_Donor 3 AM - B_adipose | 6.5 |
| 97492_Patient-10ut_uterus | 30.4 | 94732_Donor 3 AM - C_adipose | 7.6 |
| 97493_Patient-10pl_placenta | 100.0 | 94733_Donor 3 AD - A_adipose | 19.5 |
| 97495_Patient-11go_adipose | 13.1 | 94734_Donor 3 AD - B_adipose | 25.3 |
| 97496_Patient-11sk_skeletal muscle | 9.3 | 94735_Donor 3 AD - C_adipose | 9.1 |
| 97497_Patient-11ut_uterus | 30.1 | 77138_Liver_HepG2untreated | 51.1 |
| 97498_Patient-11pl_placenta | 25.0 | 73556_Heart_Cardiac stromal cells (primary) | 4.1 |
| 97500_Patient-12go_adipose | 24.0 | 81735_Small Intestine | 13.2 |
| 97501_Patient-12sk_skeletal muscle | 70.7 | 72409_Kidney_Proximal Convoluted Tubule | 21.6 |
| 97502_Patient-12ut_uterus | 13.8 | 82685_Small intestine_Duodenum | 3.7 |
| 97503_Patient-12pl_placenta | 8.5 | 90650_Adrenal_Adrenocortical adenoma | 10.9 |

TABLE RI-continued

Panel 5D

| Tissue Name | Rel. Exp. (%) Ag2248, Run 166667616 | Tissue Name | Rel. Exp. (%) Ag2248, Run 166667616 |
|---|---|---|---|
| 94721_Donor 2 U - A_Mesenchymal Stem Cells | 12.4 | 72410_Kidney_HRCE | 22.5 |
| 94722_Donor 2 U - B_Mesenchymal Stem Cells | 19.9 | 72411_Kidney_HRE | 25.3 |
| 94723_Donor 2 U - C_Mesenchymal Stem Cells | 23.5 | 73139_Uterus_Uterine smooth muscle cells | 28.7 |

TABLE RJ

Panel CNS_1

| Tissue Name | Rel. Exp. (%) Ag2248, Run 171649039 | Tissue Name | Rel. Exp. (%) Ag2248, Run 171649039 |
|---|---|---|---|
| BA4 Control | 39.8 | BA17 PSP | 29.1 |
| BA4 Control2 | 41.8 | BA17 PSP2 | 13.1 |
| BA4 Alzheimer's2 | 10.7 | Sub Nigra Control | 22.8 |
| BA4 Parkinson's | 49.7 | Sub Nigra Control2 | 42.6 |
| BA4 Parkinson's2 | 100.0 | Sub Nigra Alzheimer's2 | 15.1 |
| BA4 Huntington's | 42.9 | Sub Nigra Parkinson's2 | 54.7 |
| BA4 Huntingson's2 | 14.5 | Sub Nigra Huntington's | 58.6 |
| BA4 PSP | 4.4 | Sub Nigra Huntington's2 | 48.6 |
| BA4 PSP2 | 20.0 | Sub Nigra PSP2 | 5.1 |
| BA4 Depression | 11.7 | Sub Nigra Depression | 8.7 |
| BA4 Depression2 | 7.0 | Sub Nigra Depression2 | 11.4 |
| BA7 Control | 71.2 | Glob Palladus Control | 10.4 |
| BA7 Control2 | 30.4 | Glob Palladus Control2 | 5.9 |
| BA7 Alzheimer's2 | 9.2 | Glob Palladus Alzheimer's | 13.8 |
| BA7 Parkinson's | 17.7 | Glob Palladus Alzheimer's2 | 2.7 |
| BA7 Parkinson's2 | 60.3 | Glob Palladus Parkinson's | 50.0 |
| BA7 Huntington's | 44.8 | Glob Palladus Parkinson's2 | 10.7 |
| BA7 Huntington's2 | 49.0 | Glob Palladus PSP | 6.9 |
| BA7 PSP | 34.4 | Glob Palladus PSP2 | 7.2 |
| BA7 PSP2 | 34.2 | Glob Palladus Depression | 4.6 |
| BA7 Depression | 16.4 | Temp Pole Control | 14.6 |
| BA9 Control | 35.8 | Temp Pole Control2 | 51.1 |
| BA9 Control2 | 59.9 | Temp Pole Alzheimer's | 7.7 |
| BA9 Alzheimer's | 4.0 | Temp Pole Alzheimer's2 | 9.0 |
| BA9 Alzheimer's2 | 20.0 | Temp Pole Parkinson's | 18.6 |
| BA9 Parkinson's | 36.6 | Temp Pole Parkinson's2 | 48.6 |
| BA9 Parkinson's2 | 57.8 | Temp Pole Huntington's | 44.4 |
| BA9 Huntington's | 57.8 | Temp Pole PSP | 2.6 |
| BA9 Huntington's2 | 24.1 | Temp Pole PSP2 | 5.7 |
| BA9 PSP | 12.5 | Temp Pole Depression2 | 11.0 |
| BA9 PSP2 | 3.8 | Cing Gyr Control | 63.7 |
| BA9 Depression | 7.3 | Cing Gyr Control2 | 37.4 |
| BA9 Depression2 | 18.6 | Cing Gyr Alzheimer's | 28.5 |
| BA17 Control | 40.1 | Cing Gyr Alzheimer's2 | 14.3 |
| BA17 Control2 | 35.1 | Cing Gyr Parkinson's | 32.8 |
| BA17 Alzheimer's2 | 6.8 | Cing Gyr Parkinson's2 | 55.1 |
| BA17 Parkinson's | 39.0 | Cing Gyr Huntington's | 79.6 |
| BA17 Parkinson's2 | 51.1 | Cing Gyr Huntington's2 | 19.2 |
| BA17 Huntington's | 31.6 | Cing Gyr PSP | 14.2 |
| BA17 Huntington's2 | 20.2 | Cing Gyr PSP2 | 10.8 |
| BA17 Depression | 11.3 | Cing Gyr Depression | 4.8 |
| BA17 Depression2 | 29.5 | Cing Gyr Depression2 | 19.3 |

CNS_neurodegeneration_v1.0 Summary: Ag2248/Ag2548 Two experiments with two different probe and primer sets produce results that are in very good agreement, with highest expression in the occipital and parietal cortex (CTs=27–29) of the brains of control patients. While this gene does not appear to be differentially expressed in Alzheimer's disease, these results confirm the expression of this gene at moderate to high levels in the brains of an independent group of patients. Please see Panel 1.3d for discussion of utility in the central nervous system.

Panel 1.3D Summary: Ag2248/Ag2548 Two experiments with two different probe and primer sets show widespread expression of this gene, with highest expression seen in regions of the brain (CTs=28–29).

This gene encodes a protein that is homologous to steroid dehydrogenase. Steroid treatment is used in a number of clinical conditions including Alzheimer's disease (estrogen), menopause associated symptoms (estrogen), multiple sclerosis (glucocorticoids), and spinal cord injury (methylprednisolone). Treatment with an antagonist of this gene product, or reduction of the levels of this gene product could slow steroid degradation and lower the necessary amount given for therapeutic effect, thus reducing peripheral side effects.

This gene is moderately expressed in a variety of metabolic tissues including pancreas, adrenal, thyroid, pituitary, adult and fetal heart, adult and fetal skeletal muscle, fetal liver, and adipose. Thus, this gene product may be a small molecule drug target for the treatment of metabolic disease, including obesity and Types 1 and 2 diabetes.

The ubiquitous expression of this gene in this panel also suggests that the protein encoded by this gene plays a role in cell survival and proliferation for a majority of cell types. Furthermore, there are significant levels of expression in the lung cancer cell line SHP-77. Thus, expression of this gene could potentially be used as a diagnostic marker for some forms of lung cancer. Modulation of the gene product may also play role in treating lung cancer A prospective, randomized, and double-blind study comparing high-dose methylprednisolone sodium succinate (MPSS) with placebo, in the treatment of patients with acute cervical spinal cord injury was recently completed to evaluate the complications of high-dose MPSS in patients with acute cervical spinal cord injury when administered within 8 hours of injury. Previously, high-dose therapy with MPSS has been demonstrated to improve the recovery of motor function in patients with acute cervical spinal cord injury. Recently, forty-six patients, 42 men and 4 women (mean age, 60.6 years; range, 18–84), were included in a study: 23 in the MPSS group and 23 in the placebo group. They were treated without surgery for spinal cord injury in the cervical spine, and were enrolled in the trial if a diagnosis had been made and treatment had begun within 8 hours. Complications of high-dose therapy with MPSS were compared with placebo treatment throughout the study period and up to 2 months after injury. The MPSS group had 13 patients (56.5%) with complications, whereas the placebo group had 8 (34.8%). The difference between the two groups was not statistically significant (P=0.139). There were eight instances of pulmonary complication with MPSS (34.8%) and one instance (4.34%) with placebo (P=0.009). There were four instances of gastrointestinal complication (17.4%) with MPSS and none with placebo (P=0.036). Pulmonary complications were more prevalent in patients aged more than 60 years (P=0.029). This data suggests that aged patients with cervical spinal injury may be more likely to have pulmonary side effects (P=0.029) after high-dose therapy with MPSS and thus deserve special care. See Matsumoto, T., et al., Spine, 2001 Feb. 15; 26(4):426–30.

The number of women living in the United States who are 50 years or older has been estimated at nearly 50 million. Many of those women are likely to be eligible for postmenopausal hormone replacement, which may consist either of estrogen replacement therapy (ERT) in women without a uterus or, more frequently, estrogen/progestin combination therapy (HRT) in women with a uterus. See Holinka, C. F., Ann N Y Acad Sci, 2001 September; 943:89–108. Hormone replacement therapy with estrogen alone or with added progestin relieves menopausal symptoms and physical changes associated with depleted endogenous estrogen levels. Estrogen replacement has also demonstrated a clear benefit in the prevention of osteoporosis. Hormone replacement therapy with added progestin maintains spinal bone density, protects against postmenopausal hip fractures, and provides these benefits even when therapy is started after age 60. More recently, additional benefits have emerged. Current estrogen and hormone replacement therapy users have a 34% reduction in the risk of colorectal cancer and a 20% to 60% reduction in the risk of Alzheimer's disease. Until recently, the body of evidence indicated that hormone replacement therapy with estrogen only reduced cardiovascular disease risk by 40% to 50% in healthy patients; whether the findings of 3 ongoing trials will change this conclusion is pending availability of the final results. The many benefits of estrogen and hormone replacement therapy must be weighed against a slight increase in the risk of breast cancer diagnosis with use for 5 or more years, but which disappears following cessation of therapy. Overall, estrogen and hormone replacement therapy improves the quality of life and increases life expectancy for most menopausal women. See Burkman, R. T., et al., Am J Obstet Gynecol, 2001 August; 185(2 Suppl):S13–23.

The pharmacological effect of glucocorticoids and type 1 interferons (IFNs), simultaneously used as therapeuticals for multiple sclerosis (MS), on the (inflamed) blood-brain barrier (BBB) was investigated in vitro. Although both drugs additively decreased BBB permeability, they did not prevent the increase in BBB permeability induced by lipopolysaccharide (LPS), which served as a pro-inflammatory stimulus. The beneficial clinical effect of glucocorticoid and IFN therapy for MS seems therefore not to be mediated through a direct action at the level of the BBB. Most strikingly, however, pretreatment with type 1 IFNs (alpha and beta) potentiated the effect of glucocorticoids by two orders of magnitude. This lead us to hypothesize that type 1 IFNs may restore the dysfunctional T-helper 1 (Th1)/Th2 balance associated with MS, by a mechanism that involves an increased sensitivity for glucocorticoids. See Gaillard, P. J., et al., Neuroreport, 2001 Jul. 20; 12(10):2189–93.

Panel 2D Summary: Ag2248/Ag2548 The expression of this gene shows good concordance between two independent runs. The highest level of expression was seen in a breast cancer sample (CTs=27–29). In addition, this gene appears to be overexpressed in ovarian, gastric, breast, uterine, lung and colon cancers relative to the normal adjacent tissues from these patients. Therefore, the expression of this gene could be of use as a diagnostic marker for the presence of these cancers. Furthermore, therapeutic inhibition of the activity of this gene product may be effective in the treatment of these cancers.

Panel 3D Summary: Ag2548 This gene is expressed at a low to moderate level in most of the cells and tissues used in this panel, with highest expression in the small cell lung cancer cell line DMS-79 (CT=27.79). This ubiquitous expression suggests that the gene product plays a role in cell survival and proliferation for a majority of cell types except cell lines derived from tongue squamous cell carcinoma.

Panel 4D Summary: Ag2248 This gene encodes a steroid dehydrogenase-like protein and is expressed at moderate levels (CT=28–32) in numerous immune cell types and tissues. Small molecule antagonists that block the function of the steroid dehydrogenase-like protein encoded by this gene may be useful as therapeutics that reduce or eliminate the symptoms of patients suffering from autoimmune and inflammatory diseases such as asthma, allergies, inflammatory bowel disease, lupus erythematosus, or rheumatoid arthritis.

Panel 5 Islet Summary: Ag2248 The expression of this novel steroid dehydrogenase-like gene is highest in the liver HepG2 cell line, (CT=32.1). Lower but still significant levels of expression are seen in several placenta samples, uterine smooth muscle, adipose samples, differentiated mesenchymal stem cells, kidney and skeletal muscle from a diabetic patient. Expression in liver cells and placenta suggests that the role of this novel steroid dehydrogenase may be similar to the role of other steroid dehydrogenases which are involved in steroid and bile acid metabolism. Very low expression of this gene is also seen in a human pancreatic islet sample. Therefore, small molecule therapeutics against this gene product may be effective in disorders in which expression of this gene is dysregulated.

Panel 5D Summary: Ag2248 The expression of this gene is generally similar to that in panel 5I, although the relative abundances in each of the tissues are different. This panel shows highest expression of this steroid dehydrogenase-like gene in placenta from a diabetic patient (CT=32.2), with lower expression in other placenta samples. Relative expression of this gene is also high in the skeletal muscle of a diabetic patient and in liver HepG2 cells. Low but significant levels of expression are also seen in some adipose samples and in differentiated mesenchymal stem cells, in kidney and in uterus. Expression in liver cells and placenta suggests that the role of this novel steroid dehydrogenase may be similar to the role of other steroid dehydrogenases which are involved in steroid and bile acid metabolism. Small molecule therapeutics against this gene product may be effective in disorders in which expression of this gene is dysregulated.

Panel CNS_1 Summary: Ag2248 This panel confirms expression of this gene in the brain. Please see Panel 1.3D for discussion of potential utility in the central nervous system.

Example 3

SNP Analysis of NOVX Clones

SeqCalling™ Technology: cDNA was derived from various human samples representing multiple tissue types, normal and diseased states, physiological states, and developmental states from different donors. Samples were obtained as whole tissue, cell lines, primary cells or tissue cultured primary cells and cell lines. Cells and cell lines may have been treated with biological or chemical agents that regulate gene expression for example, growth factors, chemokines, steroids. The cDNA thus derived was then sequenced using CuraGen's proprietary SeqCalling technology. Sequence traces were evaluated manually and edited for corrections if appropriate. cDNA sequences from all samples were assembled with themselves and with public ESTs using bioinformatics programs to generate CuraGen's human SeqCalling database of SeqCalling assemblies. Each assembly contains one or more overlapping cDNA sequences derived from one or more human samples. Fragments and ESTs were included as components for an assembly when the extent of identity with another component of the assembly was at least 95% over 50 bp. Each assembly can represent a gene and/or its variants such as splice forms and/or single nucleotide polymorphisms (SNPs) and their combinations.

Variant sequences are included in this application. A variant sequence can include a single nucleotide polymorphism (SNP). A SNP can, in some instances, be referred to as a "cSNP" to denote that the nucleotide sequence containing the SNP originates as a cDNA. A SNP can arise in several ways. For example, a SNP may be due to a substitution of one nucleotide for another at the polymorphic site. Such a substitution can be either a transition or a transversion. A SNP can also arise from a deletion of a nucleotide or an insertion of a nucleotide, relative to a reference allele. In this case, the polymorphic site is a site at which one allele bears a gap with respect to a particular nucleotide in another allele. SNPs occurring within genes may result in an alteration of the amino acid encoded by the gene at the position of the SNP. Intragenic SNPs may also be silent, however, in the case that a codon including a SNP encodes the same amino acid as a result of the redundancy of the genetic code. SNPs occurring outside the region of a gene, or in an intron within a gene, do not result in changes in any amino acid sequence of a protein but may result in altered regulation of the expression pattern for example, alteration in temporal expression, physiological response regulation, cell type expression regulation, intensity of expression, stability of transcribed message.

Method of novel SNP Identification: SNPs are identified by analyzing sequence assemblies using CuraGen's proprietary SNPTool algorithm. SNPTool identifies variation in assemblies with the following criteria: SNPs are not analyzed within 10 base pairs on both ends of an alignment; Window size (number of bases in a view) is 10; The allowed number of mismatches in a window is 2; Minimum SNP base quality (PURED score) is 23; Minimum number of changes to score an SNP is 2/assembly position. SNPTool analyzes the assembly and displays SNP positions, associated individual variant sequences in the assembly, the depth of the assembly at that given position, the putative assembly allele frequency, and the SNP sequence variation. Sequence traces are then selected and brought into view for manual validation. The consensus assembly sequence is imported into CuraTools along with variant sequence changes to identify potential amino acid changes resulting from the SNP sequence variation. Comprehensive SNP data analysis is then exported into the SNPCalling database.

Method of novel SNP Confirmation: SNPs are confirmed employing a validated method know as Pyrosequencing (Pyrosequencing, Westborough, Mass.). Detailed protocols for Pyrosequencing can be found in: Alderborn et al. Determination of Single Nucleotide Polymorphisms by Real-time Pyrophosphate DNA Sequencing. (2000). *Genome Research.* 10, Issue 8, August. 1249–1265. In brief, Pyrosequencing is a real time primer extension process of genotyping. This protocol takes double-stranded, biotinylated PCR products from genomic DNA samples and binds them to streptavidin beads. These beads are then denatured producing single stranded bound DNA. SNPs are characterized utilizing a technique based on an indirect bioluminometric assay of pyrophosphate (PPi) that is released from each dNTP upon DNA chain elongation. Following Klenow polymerase-mediated base incorporation, PPi is released and used as a substrate, together with adenosine 5'-phosphosulfate (APS), for ATP sulfurylase, which results in the formation of ATP. Subsequently, the ATP accomplishes the conversion of luciferin to its oxi-derivative by the action of luciferase. The ensuing light output becomes proportional to the number of added bases, up to about four bases. To allow processivity of the method dNTP excess is degraded by apyrase, which is also present in the starting reaction mixture, so that only dNTPs are added to the template during the sequencing. The process has been fully automated and adapted to a 96-well format, which allows rapid screening of large SNP panels. The DNA and protein sequences for the novel single nucleotide polymorphic variants are reported. Variants are reported individually but any combination of all or a select subset of variants are also included. In addition, the positions of the variant bases and the variant amino acid residues are underlined.

RESULTS

Variants are reported individually but any combination of all or a select subset of variants are also included as contemplated NOVX embodiments of the invention.
NOV5

The DNA and protein sequences for the novel single nucleotide polymorphic variants of the Sharp-1-like gene of CuraGen Acc. No. NOV5 GSAC022509_A_ are reported individually but any combination of all or a select subset of variants are also included. The positions of the variant bases and the variant amino acid residues are underlined. In summary, there are five variants reported. Variant 13375934 is a C to T SNP at 1158 bp of the nucleotide sequence that results in no change in the protein sequence (silent), variant 13375935 is a G to A SNP at 1189 bp of the nucleotide sequence that results in an Ala to Thr change at amino acid 397 of protein sequence, variant 13375936 is a T to C SNP at 1242 bp of the nucleotide sequence that results in no change in the protein sequence (silent), variant 13375937 is an A to G SNP at 1264 bp of the nucleotide sequence that results in a Thr to Ala change at amino acid 422 of protein sequence, and variant 13375938 is an A to G SNP at 1306 bp of the nucleotide sequence that results in a Ser to Gly change at amino acid 436 of protein sequence.

NOV6

The DNA and protein sequences for the novel single nucleotide polymorphic variants of the SynaptotagminX-like gene of CuraGen Acc. No. GSAC023158_15_A_ are reported individually but any combination of all or a select subset of variants are also included. In summary, there is 1 variant, namely variant 13375933 is a G to A SNP at 1562 bp of the nucleotide sequence that results in a Trp to Stop Signal change at amino acid 495 of protein sequence.

NOV7

The DNA and protein sequences for the novel single nucleotide polymorphic variants of the Type II Cytokeratin-like gene of CuraGen Acc. No. GSAC055715_A are reported individually but any combination of all or a select subset of variants are also included. In summary, there is I variant, namely variant 13375932 is an A to C SNP at 23 bp of the nucleotide sequence that results in a Lys to Thr change at amino acid 8 of protein sequence.

NOV8

The following amino acids are different between NOV8a and NOV8b. It is contemplated that the variant residues are structurally variable and possibly functionally variable:

TABLE 22

| Position | Amino Acid difference |
|---|---|
| 53 | T→A |
| 73 | E→G |
| 204 | V→L |
| 234 | L→P |
| 398 | G→R |
| 563 | G→D |
| 648 | S→R |
| 795 | D→N |
| 912–988 | Different 3' end. |

NOV9

The DNA and protein sequences for the novel single nucleotide polymorphic variants of the Potassium channel regulatory subunit-like gene of GSAC046130_A are reported individually but any combination of all or a select subset of variants are also included. The position of the single variant 13374188 is a T to C SNP at 1416 bp of the nucleotide sequence that results in no change in the protein sequence (silent).

NOV11

The DNA and protein sequences for the novel single nucleotide polymorphic variants of the Steroid Dehydrogenase-like gene of CuraGen Acc. No. SCI 11743377_A are reported individually but any combination of all or a select subset of variants are also included. The position of the single variant 13375812 is an A to G SNP at 293 bp of the nucleotide sequence that results in an Ile to Val change at amino acid 79 of protein sequence.

NOV12

The DNA and protein sequences for the novel single nucleotide polymorphic variants of the SEC6-like gene of CuraGen Acc. No. 4418354_0_9_da1 are reported individually but any combination of all or a select subset of variants are also included. In summary, there are 8 variants. Variant 13375954 is a C to T SNP at 92 bp of the nucleotide sequence that results in no change in the protein sequence since the SNP is not in the amino acid coding region. Variant 13374460 is an A to G SNP at 334 bp of the nucleotide sequence that results in a Gin to Arg change at amino acid 77 of protein sequence. Variant 13375955 is a T to C SNP at 412 bp of the nucleotide sequence that results in a Val to Ala change at amino acid 103 of protein sequence. Variant 13375956 is a G to A SNP at 551 bp of the nucleotide sequence that results in no change in protein sequence (silent). Variant 13375957 is a C to T SNP at 1126 bp of the nucleotide sequence that results in a Thr to Met change at amino acid 341 of protein sequence. Variant c110.3906 is a T to C SNP at 2473 bp of the nucleotide sequence that results in no change in the protein sequence since the SNP is not in the amino acid coding region. Variant c110.3905 is an insertion of nucleotide G after 2557 bp of the nucleotide sequence that results in no change in the protein sequence since the SNP is not in the amino acid coding region. Variant c110.3904 is an insertion of nucleotide G after 2559 bp of the nucleotide sequence that results in no change in the protein sequence since the SNP is not in the amino acid coding region.

NOV14

The DNA and protein sequences for the novel single nucleotide polymorphic variants of the Protein Kinase SNF1LK-like gene of CuraGen Acc. No. 95073892_da1 (also referred to as CG53072-02) are reported individually but any combination of all or a select subset of variants are also included. In summary, there are 2 variants. The insert assemblies 175069796 and 175069803 were both found to encode an open reading frame between residues 1 and 208 of the target sequence CG53072-02. Both differ from the CG53072-02 sequence at 1 nucleotide and 1 amino acid position. Variant 175069796 is a T to C SNP at 263 bp of the nucleotide sequence that results in an Ile to Thr change at amino acid 86 of the CG53072-02 protein sequence. Variant 175069803 is a C to T SNP at 436 bp of the nucleotide sequence that results in a His to Tyr change at amino acid 144 of the CG53072-02 protein sequence. The alignment with CG53072-02 is displayed in a ClustalW below. Note that differing amino acids have a white or grey background, and deleted/inserted amino acids can be detected by a dashed line in the sequence that does not code at that position.

(1) CG53072-02 (SEQ ID NO:287)
(2) 175069796 (SEQ ID NO:288)
(3) 175069803 (SEQ ID NO:289)

```
CG53072-02   1  --MVIMSEFSADPAGQQQQQQKPLRVGFYDIERTLGKGNFAVVKLARHRVTKT Q VAIKII  58
175069796    1  GSMVIMSEFSADPAGQQQQQQKPLRVGFYDIERTLGKGNFAVVKLARHRVTKT Q VAIKII  60
175069803    1  GSMVIMSEFSADPAGQQQQQQKPLRVGFYDIERTLGKGNFAVVKLARHRVTKT Q VAIKII  60

CG53072-02  59  DKIRLDSSNLEKTYREVQLMKLLNHPHIIKLYQVMETKDMLYIVTEFAKNGEM F DYLTSN 118
175069796   61  DKIRLDSSNLEKTYREVQLMKLLNHPHTIKLYQVMETKDMLYIVTEFAKNGEM F DYLTSN 120
175069803   61  DKIRLDSSNLEKTYREVQLMKLLNHPHIIKLYQVMETKDMLYIVTEFAKNGEM F DYLTSN 120
```

```
CG53072-02  119 GHLSENEARKKFWQILSAVEYCHDHHIVHRDLKTENLLLDGNMDIKLADFGFG N FYKSGE 178
175069796   121 GHLSENEARKKFWQILSAVEYCHDHHIVHRDLKTENLLLDGNMDIKLADFGFG N FYKSGE 180
175069803   121 GHLSENEARKKFWQILSAVEYCHDHYIVHRDLKTENLLLDGNMDIKLADFGFG N FYKSGE 180

CG53072-02  179 PLSTWCGSPPYAAPEVFEGKEYEGPQLDTWSLGVVLYVLVCGSLPFDGPNLPT L RQRVLE 238
175069796   181 PLSTWCGSPPYAAPEVFEGKEYEGPQLDTWSLE--------------------- - ------ 213
175069803   181 PLSTWCGSPPYAAPEVFEGKEYEGPQLDTWSLE--------------------- - ------ 213

CG53072-02  239 GRFRIPFFMSQDCESLIRLARLAPGCEPLGLLQGDCEMGDLMPCSLGTFVLVQ                291
175069796       ...   ------------------------------------------------------            ...
175069803       ...   ------------------------------------------------------            ...
```

TABLE 23A

Variant 175069796 nucleotide sequence (SEQ ID NO:253)

GGATCCATGGTTATCATGTCGGAGTTCAGCGCGGACCCCGCGGGCCAGGGTCAGGGCCAGCAGAAGCCCC

TCCGGGTGGGTTTTTACGACATCGAGCGGACCCTGGGCAAAGGCAACTTCGCGGTGGTGAAGCTGGCGCG

GCATCGAGTCACCAAAACGCAGGTTGCAATAAAAATAATTGATAAAACACGATTAGATTCAAGCAATTTG

GAGAAAATCTATCGTGAGGTTCAGCTGATGAAGCTTCTGAACCATCCACACACCATAAAGCTTTACCAGG

TTATGGAAACAAAGGACATGCTTTACATCGTCACTGAATTTGCTAAAAATGGAGAAATGTTTGATTATTT

GACTTCCAACGGGCACCTGAGTGAGAACGAGGCGCGGAAGAAGTTCTGGCAAATCCTGTCGGCCGTGGAG

TACTGTCACGACCATCACATCGTCCACCGGGACCTCAAGACCGAGAACCTCCTGCTGGATGGCAACATGG

ACATCAAGCTGGCAGATTTTGGATTTGGGAATTTCTACAAGTCAGGAGAGCCTCTGTCCACGTGGTGTGG

GAGCCCCCCGTATGCCGCCCCGGAAGTCTTTGAGGGGAAGGAGTATGAAGGCCCCCAGCTGGACATCTGG

AGCCTCGAG

TABLE 23B

Variant 175069803 nucleotide sequence (SEQ ID NO:244)

GGATCCATGGTTATCATGTCGGAGTTCAGCGCGGACCCCGCGGGCCAGGGTCAGGGCCAGCAGAAGCCCC

TCCGGGTGGGTTTTTACGACATCGAGCGGACCCTGGGCAAAGGCAACTTCGCGGTGGTGAAGCTGGCGCG

GCATCGAGTCACCAAAACGCAGGTTGCAATAAAAATAATTGATAAAACACGATTAGATTCAAGCAATTTG

GAGAAAATCTATCGTGAGGTTCAGCTGATGAAGCTTCTGAACCATCCACACATCATAAAGCTTTACCAGG

TTATGGAAACAAAGGACATGCTTTACATCGTCACTGAATTTGCTAAAAATGGAGAAATGTTTGATTATTT

GACTTCCAACGGGCACCTGAGTGAGAACGAGGCGCGGAAGAAGTTCTGGCAAATCCTGTCGGCCGTGGAG

TACTGTCACGACCATTACATCGTCCACCGGGACCTCAAGACCGAGAACCTCCTGCTGGATGGCAACATGG

ACATCAAGCTGGCAGATTTTGGATTTGGGAATTTCTACAAGTCAGGAGAGCCTCTGTCCACGTGGTGTGG

GAGCCCCCCGTATGCCGCCCCGGAAGTCTTTGAGGGGAAGGAGTATGAAGGCCCCCAGCTGGACATCTGG

AGCCTCGAG

NOV15

The DNA and protein sequences for the novel single nucleotide polymorphic variants of the CD39L2-like gene of CuraGen Acc. No. ba294a4_20000808 are reported individually but any combination of all or a select subset of variants are also included. In summary, there are 7 variants. Variant c10.4063 is an insertion of nucleotide C after 2187 bp of the nucleotide sequence, variant c110.4062 is an insertion of nucleotide G after 2214 bp of the nucleotide sequence, variant c110.4061 is an insertion of nucleotide C after 2347 bp of the nucleotide sequence, variant c110.4060 is a T to C SNP at 2373 bp of the nucleotide sequence, variant c110.4059 is an insertion of nucleotide C after 2414 bp of the nucleotide sequence, variant c110.4058 is an insertion of nucleotide C after 2529 bp of the nucleotide sequence, and variant c110.4057 is an insertion of nucleotide T after 2621 bp of the nucleotide sequence. All result in no change in the protein sequence since the SNP's are not in the amino acid coding region.

NOV18

The DNA and protein sequences for the novel single nucleotide polymorphic variants of the Calcium Transporter-like gene of CuraGen Acc. No. AC073079_C are reported individually but any combination of all or a select subset of variants are also included. In summary, there are 2 variants. Variant 13375948 is a G to A SNP at 357 bp of the nucleotide sequence that results in no change in the protein sequence (silent). Variant 13375949 is a G to A SNP at 436 bp of the nucleotide sequence that results in an Ala to Thr change at amino acid 146 of protein sequence.

NOV20

The insert assemblies 214458616 and 214458668 were both found to encode an open reading frame between residues 13 and 116 of the target sequence CG56872-03 (GABA Receptor-Associated Protein-like gene). The alignment with CG56872-03 is displayed in a ClustalW below. Note that differing amino acids have a white or grey background, and deleted/inserted amino acids can be detected by a dashed line in the sequence that does not code at that position.

OTHER EMBODIMENTS

Although particular embodiments have been disclosed herein in detail, this has been done by way of example for purposes of illustration only, and is not intended to be limiting with respect to the scope of the appended claims, which follow. In particular, it is contemplated by the inventors that various substitutions, alterations, and modifications may be made to the invention without departing from the spirit and scope of the invention as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims.

```
                    Alignment of NOV20 SNP Variant Proteins
214458616  (SEQ ID NO:290)
214458668  (SEQ ID NO:291)
CG56872-03 (SEQ ID NO:292)

214458616    1 ----------GSYRKKEGEKIRKKYPDRVPVIVEKAPKARVFDLDKRKYLVPSDLTVGQP  50
214458668    1 ----------GSYRKKEGEKIQKKYPDRVPVIVEKAPKARVPDLDKRKYLVPSDLTVGQP  50
CG56872-03_  1 MKFQYKEVHPFEYRKKEGEKIRKKYPDRVPLIVEKAPKARVPDLDRRKYLVPSDLTDGQP  60

214458616   51 YFLIRKRIHLRPEDALFFFVNNTIPPTSATMGQLYEDNHEEDYFLYVAYSNESVYGLE  108
214458668   51 YFLIRKRIHLRPEDALFFFVNNTIPPTSATMGQLYEDNHEEDYFLYVAYSNESVYGLE  108
CG56872-03_ 61 YLLIRKRIHLRPEDALFFFVNNTIPPTSATMGQLYEDSHEEDDFLYVAYSNESVYGK-  117
```

TABLE 24A

Variant 21448616 nucleotide sequence (SEQ ID NO:255)

GGATCCTATCGGAAAAAGGAAGGAGAAAAGATCCGGAAGAAATATCCGGACAGGGTCCCCGTGATTGTAG

AGAAGGCTCCAAAAGCCAGGGTGCCTGATCTGGACAAGAGGAAGTACCTAGTGCCCTCTGACCTTACTGT

TGGCCAGTTCTACTTCTTAATCCGGAAGAGAATCCACCTGAGACCTGAGGACGCCTTATTCTTCTTTGTC

AACAACACCATCCCTCCCACCAGTGCTACCATGGGCCAACTGTATGAGGACAATCATGAGGAAGACTATT

TTCTGTATGTGGCCTACAGTAATGAGAGTGTCTATGGGCTCGAG

TABLE 24B

Variant 214458668 nucleotide sequence (SEQ ID NO:256)

GGATCCTATCGGAAAAAGGAAGGAGAAAAGATCCAGAAGAAATATCCGGACAGGGTCCCCGTGATTGTAG

AGAAGGCTCCAAAAGCCAGGGTGCCTGATCTGGACAAGAGGAAGTACCTAGTGCCCTCTGACCTTACTGT

TGGCCAGTTCTACTTCTTAATCCGGAAGAGAATCCACCTGAGACCTGAGGACGCCTTATTCTTCTTTGTC

AACAACACCATCCCTCCCACCAGTGCTACCATGGGCCAACTGTATGAGGACAATCATGAGGAAGACTATT

TTCTGTATGTGGCCTACAGTAATGAGAGTGTCTATGGGCTCGAG

SEQUENCE LISTING (292 sequences)

SEQ ID NO: 1 - DNA, 2331 bp, Homo sapiens
cagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatatggacccgatgaacatagacacaggaagttcacaaatgggtgctaccatagtagatgctttggataccctttatatcatgggacttcatgatgaattcctagatgggcaaagatggattgaagacaaccttgatttcagtgtgaattcagaggtgtctgtgtttgaagtcaacattcgatttattggaggcctacttgcagcatattacctatcaggagaggagatattcaagattaaagcagtgcaattggctgagaaactccttcctgcctttaacacacctactgggattccttgggcaatggtgaatttgaaaagtggagtagggcgaaactggggctgggcatctgcaggtagcagcattctggctgaatttggtacactacatatggagttcatccacctcagctacttgacaggggacctgacttactacaaaaaggttatgcacattcggaaactacttcagaaaatggatcgtccaaatggtctttatccaaattatttgaaccccagaacagggcgctggggtcagtatcatacatctgtcggtggcctgggagacagtttttatgaatacttactgaaagcatggttgatgtcagataaaacagaccatgaggcaagaaagatgtatgatgatgctattgaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactgcattaaagctaggtcctgaatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaaggcaaagtactgtctttgatccaagtcttccccatctttctctctctactggtggcagtatgattcttggacgtcaacaacctgccacagagaagagaggaagtattgttcgtttcatgcctgatagcccacaagtacctaatgataattcaggtcctgaccagcatacactatcacaaaattttggtttttcttttattcctgagggtggcatgaatccaccaataaatgctaatgcttctttcattccccaggttactcagcctagtgccactcgcactccagcctgggcaacagagccagactccatctattaaaatttgaaaacttaaaaaaactctcctgctcatcctacactgtccaatgatatttcaatcccctattttcctaatcagatgttctcaaatcctaggcacagaggaagggtaaacagtggggaggt

SEQ ID NO: 2 - protein, 711 aa, Homo sapiens [sequence omitted]

SEQ ID NO: 3 - DNA, 2692 bp, Homo sapiens
cagggtggctccgctttcgagcccgggcgcggcgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaattatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtggggatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccgattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggt

SEQ ID NO: 4 - protein, 869 aa, Homo sapiens
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFRFDTSFMYMIAGLCMLKLYQTRHPDINASAYSAYASFAVVIMVTVLGVVFGKNDVWFWVIFSAIHVLASLALSTQIYYMGRFKIDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 5 - DNA, 716 bp, Homo sapiens
cagattcttcctaacctgttggtgagaactacaacacaagatggccgcaaataagcccaagggtcagaataatttggccttacacaaagtcatcacggtgggcagtgccggtgtgggcaaggcagctctgactctacagttcatgtacgatcaatttcttaaaccttatgaaccatctaaagaaggcacctatcggaagagagtagtactggatggcgaggaagtacagatcggtatcttagaaacagctgggcaggaggactatgctgcaattagggacaactatttccgaagcagagaggggtttctctgtgtcttctctattacagaaatggaatcctttgcagctacagctgacttcagggagcagattttaagagtaaaagaagatgagaatgttccatttctactggttggtaacaaatcagatttagaagataaaaggccggtttctgtaaaagaggcaaaaaacagagctgaccagtggaatgttaactatgtggaaacatctgctaaaacacaggctaatgttgacaaggtactttttgatttaatgagagaaattcgagcaaaaaagatggaagacagcaaagaaaagaatggaaaaaagaagaggaaaagttcagccaagagaatcagagaaaggtgctgcattttataatcaaagtccaaattcctttcttatcttgaccatactaataaatataatttataag

SEQ ID NO: 6 - protein, 206 aa, Homo sapiens
MAANKPKGQNNLALHKVITVGSAGVGKAALTLQFMYDQFLKPYEPSKEGTYRKRVVLDGEEVQIGILETAGQEDYAAIRDNYFRSREGFLCVFSITEMESFAATADFREQILRVKEDENVPFLLVGNKSDLEDKRPVSVKEAKNRADQWNVNYVETSAKTQANVDKVLFDLMREIRAKKMEDSKEKNGKKKRKSSAKRIRERCCIL

SEQ ID NO: 7 - DNA, 723 bp, Homo sapiens
tacaccgcccgcctggtggatcagaaatggctgcgactcgcggcgaggagaaaatctgcatgagcatgtatcaacgcattaatggcgctgactggcgcaatattttcgtcgtcggcgatctgcatgggtgctacacgctgctgatgaatgaactcgaaaaggtttcgttcgaccctgcgtgtgatttgctgatttcggttggagaccttgttgaccgcggcgcggaaaacgtcgagtgcctggagctgattactatgccttggttccgggctgtgcgaggtaaccatgagcagatgatgattgatgggctatcggagtatggaaacgttaaccactggctggaaaacgcgggggggtggttcctcagtcctgattatgaaaaagaggggctggctaaggctctggttcataaatgggccagcctgccattcgtcatcgagctggttaccgctgaacgtaaaatgggtatttgccccgctgactacccgcataacgaaaatggcgtcaaaaggccgtcccaaagaaatgtccttttgaatcgggaacgggttaccacccctagaacggatttggcccccccaaagccgtgggctgatctgtttattttttgggcccaacccctggggggcccagccccctggaagtttgcccaccacaaatgtcaatctataaccgggggcgcgcggttctgtgggaaacactaaccctctgggacaaggggaa

SEQ ID NO: 8 - protein, 214 aa, Homo sapiens
MSMYQRINGADWRNIFVVGDLHGCYTLLMNELEKVSFDPACDLLISVGDLVDRGAENVECLELITMPWFRAVRGNHEQMMIDGLSEYGNVNHWLENAGGWFLSPDYEKEGLAKALVHKWASLPFVIELVTAERKMGICPADYPHNENGVKRPSQRNVLLNRERVTTPRTDLAPPKPWADLFIFWAQPLGGPAPWKFAHHKCQSITGGARFCGKH

SEQ ID NO: 9 - DNA, 2304 bp, Homo sapiens
atgcctttctcctggaagctgctctcttcaagccaactgccagaggcagaaggcacagctgcagggacaggacaaccacaggacaggactccggagactgcagcagcgcgagcggccgccgcggcccgggctgctcctggagtcggggaggagacgcgactcccgcagacacgtgacctcctcccagccgccgcttcccgcgacccagatccgtccccggaacccgtgcccggcggggcgggccgggggacacggcgagcgcgcgcgcgcacgggttccccgagcagtgatgtggcagcagcggcaggtcggatcacgttgctggccctgtgctggtacccgtttgagaccggattaaggagggaggctttggaggtgccagcggtagtaaaccccccactcaaccccggctcgctccccgccgcgttcctccaggagcacacgcggccccaaacgtcgtcatctgctgctgtgattagtggcaccgcaattccggctgatgcgggaagtttagttggcccagggacgccgtgtcaccgaaagacacttggattgcgacatttcgacccagtgacaacgttttcatgtatcttaaatccttcaggagcggatcgcaagttgcttcttctcgaggcaacctctccacccagcgccaaggagtccctccaggccactgatcacgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctga

SEQ ID NO: 10 - protein, 767 aa, Homo sapiens
MPFSWKLLSSSQLPEAEGTAAGTGQPQDRTPETAAARAAAAARAAPGVGEETRLPQTRDLLPAAASRDPDPSPEPVPGGAGRGTRRARARTGSPSSDVAAAAGRITLLALCWYPFETGLRREALEVPAVVNPPLNPGSLPAAFLQEHTRPQTSSSAAVISGTAIPADAGSLVGPGTPCHRKTLGLRHFDPVTTFSCILNPSGADRKLLLLEATSPPSAKESLQATDHAVEGGDQLLHTFNTALKRESERETGDAQIPPRSPKPTVPQIIVQSPKNRNRGNEQQLNMDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 11 - DNA, 1702 bp, Homo sapiens
cagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacagatatttcagtcagcctgttagctgtcgttgtcagcttttgtggactggccttgttggttgtctcactttttgtcttctggaagctgtgttggccatgctggaaaagcaaacctgtgacttccaacatcactacgcttccacagagcatttcaagtgctcctactgaagtttttgagactgaagagaaaaaagaaattaaggaaaatgaaaagccagccgtaaaagctattgagcctgcaataaaaatcagccacacttcccctgacatcccagcagaagtccaaactgctttaaaagaacatttaattaaacatgcacgtgtgcaaagacaaattactgagcctacgtcatcaacccggcacagttccttccgaagacacctgccgaggcaaatgcaggtttccagtgttgattttagcatgggcacagaacctgttttacaacgaggagaaacaacaaccagcattgggaggataaagccagaactctacaaacagaaatcagttgactctgagggcaaccaaaacgaagatgtcaaaatctgtgggaaacttaactttaccctccagtatgattatgaaaatgaacttctagttgttaaaattatcaaagctttagatctccctgctaaagacttcacaggaacttctgacccttatgtgaagatgtatcttcttccagataggaaaaagaaatttcagacccgcgtgcacagaaagactttaaatcctctatttgatgaaacttttcaatttcctgtagcatatgatcaactaagcaaccgaaaactacatttcagtgtgtatgattttgacagattttctagacatgacatgattggggaagtgattcttgataatttgtttgaagtctctgatctctccagggaagccacagtatggaaagatattcactgtgctaccacagaaagtatagacctgggtgaaatcatgttttccctttgttacctaccgacggctgggcgtatgacattgacagtcattaagtgcagaaatctgaaggcgatggatattactggctcatcagatccttatgtcaaagtgtccctgatgtgtgaaggtcgaagattaaaaaagaggaaaacaactacaaagaaaaacactctaaaccctgtgtacaatgaggccattatttttgacatccctccagagaacgtggaccaggtcagcctctccattgcggtcatggattacgatagggtaggacacaatgaggtcataggagtgtgcagaacaggactggatgctgagggtcttgggcgagaccactggaatgaaatgctggcctatcatcgaaaaccaataacgcactggcacccattgctggagttacctggccgggcgaccagttttgatagtcaaggatcctgcccttctcctaaaccaccttccacaccataatgcctccaaaatgagaccatgatattaagcatctaggatcacgtgctcattga

SEQ ID NO: 12 - protein, 523 aa, Homo sapiens
MSFHKEDGVNSLCQKALHIVTELCFAGQVEWEKCSGIFPRDRGSQGGSSTDISVSLLAVVVSFCGLALLVVSLFVFWKLCWPCWKSKPVTSNITTLPQSISSAPTEVFETEEKKEIKENEKPAVKAIEPAIKISHTSPDIPAEVQTALKEHLIKHARVQRQITEPTSSTRHSSFRRHLPRQMQVSSVDFSMGTEPVLQRGETTTSIGRIKPELYKQKSVDSEGNQNEDVKICGKLNFTLQYDYENELLVVKIIKALDLPAKDFTGTSDPYVKMYLLPDRKKKFQTRVHRKTLNPLFDETFQFPVAYDQLSNRKLHFSVYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLSIAVMDYDRVGHNEVIGVCRTGLDAEGLGRDHWNEMLAYHRKPITHWHPLLELPGRATSFDSQGSCPSPKPPSTP

SEQ ID NO: 13 - DNA, 1611 bp, Homo sapiens
atgagtcggcaactgaacatcaagtccagtggtgacaagggcaacttcagtgtgcattcggcagtggtgccaaggaaggctgtgggtagcctggcttcttactgtgcagctggcagaggggctggcgctggctttggcagtcggagcctctatagccttggagggaatcggcgtatttctttcaatgtggctggtggcggcgttcgggctggaggttacggcttcaggcctggctctgggtatggagggggccgggccagtggctttgctggcagtatgtttggcagtgtggccctggggcctgcatgtttgtctgtgtgcccacctgggggcatccaccaggtcactgtcaacaagagcctcttggcccccctcaacgtggagctggaccctgagatccagaaggtgcgcgcccaggagcgggaacagatcaaggtgctgaacgacaagttcgcctccttcattgacaaggtacgcttcctagagcagcagaaccaggttctagaaaccaagtgggagctgctgcagcagctggacctgaacaactgcaagaagaacctggagcccatccttgagggctacatcagcaacctgcggaagcagctggagacactgtctggggacagggtgaggctggactcggagctgagaagcatgagggatctggtggaggactataagaagagatatgaagtggagattaaccggcgcacgacagcagagaatgagtttgtggtgcttaagaaggatgcagatgcagcctacgcagtcaaggtggagcttcaggccaaagtggactcactggacaaagaaatcaagttcctcaagtgtctgtatgatgcagagatcgctcagatccagactcacgccagtgagacctctgtcatcctgtccatggacaacaaccgggacctggaccttgacagcatcatcgctgaggtccgcatgcattatgaggagatcgccctgaagagcaaggccgaggccgaggccctgtaccagaccaagttcctatctctgggaaaccagatccaggagctgcagctggcagccagtcggcatggtgacgacctgaaacacaccaggagcgagatggtggagctgaaccggctcatccagaggatccggtgtgagatcgggaatgtgaagaagcagcgtgccagcctggagacggccatcgctgacgctgagcagcggggagacaatgccctgaaggatgcccaggccaagctggatgagctggagggcgccctgcaccaggccaaggaggagctggcgcggatgctgcgcgagtaccaggagctcatgagcctgaaactggccctggacatggagattgccacctaccgcaagctgctggagggcgaggagtgcaggatgtctggtgagaatccatcctctgtgagcatctctgtcatcagcagtagcagctacagctaccaccaccccagctctgcgggtgttgaccttggggccagcgctgtggcaggcagctctggcagcacccagagcgggcagaccaagaccacagaggcgcgagggggagacctcaaggacacccagggcaagagcaccccagccagcatcccagcaaggaaagccacccgctag

SEQ ID NO: 14 - protein, 536 aa, Homo sapiens
MSRQLNIKSSGDKGNFSVHSAVVPRKAVGSLASYCAAGRGAGAGFGSRSLYSLGGNRRISFNVAGGGVRAGGYGFRPGSGYGGGRASGFAGSMFGSVALGPACLSVCPPGGIHQVTVNKSLLAPLNVELDPEIQKVRAQEREQIKVLNDKFASFIDKVRFLEQQNQVLETKWELLQQLDLNNCKKNLEPILEGYISNLRKQLETLSGDRVRLDSELRSMRDLVEDYKKRYEVEINRRTTAENEFVVLKKDADAAYAVKVELQAKVDSLDKEIKFLKCLYDAEIAQIQTHASETSVILSMDNNRDLDLDSIIAEVRMHYEEIALKSKAEAEALYQTKFLSLGNQIQELQLAASRHGDDLKHTRSEMVELNRLIQRIRCEIGNVKKQRASLETAIADAEQRGDNALKDAQAKLDELEGALHQAKEELARMLREYQELMSLKLALDMEIATYRKLLEGEECRMSGENPSSVSISVISSSSYSYHHPSSAGVDLGASAVAGSSGSTQSGQTKTTEARGGDLKDTQGKSTPASIPARKATR

SEQ ID NO: 15 - DNA, 3016 bp, Homo sapiens
tggcggagcggcgagcagcgagcagcgcctgcgggagcggccggtcggtcgggtccccgcgccccgcacgcccgcacgcccagcggggcccgcattgagcatgggcgcggcggccgtgcgctggcacttgtgcgtgctgctggccctgggcacacgcgggcggctggccgggggcagcgggctcccaggttcagtcgacgtggatgagtgctcagagggcacagatgactgccacatcgatgccatctgtcagaacacgcccaagtcctacaaatgcctctgcaagccaggctacaagggggaaggcaagcagtgtgaagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacagtaacctgtaattatggaaacggaggctgccagcacagctgtgaggacacagacacaggccccacgtgtggttgccaccagaagtacgccctccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtgggcagcttcgagtgcggctgccggaagggctacaagctgctcaccgacgagcgcacctgccaggacatcgacgagtgctccttcgagcggacctgtgaccacatctgcatcaactccccgggcagcttccagtgcctgtgtcaccgcggctacatcctctacgggacaacccactgcggagatgtggacgagtgcagcatgagcaacgggagctgtgaccagggctgcgtcaacaccaagggcagctacgagtgcgtctgtcccccggggaggcggctccactggaacgggaaggattgcgtggagacaggcaagtgtctttctcgcgccaagacctccccccgggcccagctgtcctgcagcaaggcaggcggtgtggagagctgcttcctttcctgcccggctcacacactcttcgtgccagactcggaaaatagctacgtcctgagctgcggagttccagggccgcagggcaaggcgctgcagaaacgcaacggcaccagctctggcctcgggcccagctgctcagatgcccccaccacccccatcaaacagaaggcccgcttcaagatccgagatgccaagtgccacctccggccccacagccaggcacgagcaaaggagaccgccaggcagccgctgctggaccactgccatgtgactttcgtgaccctcaagtgtgactcctccaagaagaggcgccgtggccgcaagtccccatccaaggaggtgtcccacatcacagcagagtttgagatcgagacaaagatggaagaggcctcaggtacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcgttgcctgtgggcctggcacccacttcggtggtgagctcggccagtgtgtgtcatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaagaccagcactgcggcggcgagcttggtgactacaccggctacatcgagtcccccaactaccctggcgactacccagccaacgctgaatgcgtctggcacatcgcgcctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatggtaagatccactgtcttcacggcccactgtgcacggctcaggcggggccctggagacacagagatgagtcgcacgtccccgccctcagggagctgcgacctggcaggtacggcctcacagaaacagaagggcaaatgcaaatgctgggaggagctgtttaatcgttcagggaggctgatagc

SEQ ID NO: 16 - protein, 964 aa, Homo sapiens
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTVTCNYGNGGCQHSCEDTDTGPTCGCHQKYALHSDGRTCIETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGDVDECSMSNGSCDQGCVNTKGSYECVCPPGRRLHWNGKDCVETGKCLSRAKTSPRAQLSCSKAGGVESCFLSCPAHTLFVPDSENSYVLSCGVPGPQGKALQKRNGTSSGLGPSCSDAPTTPIKQKARFKIRDAKCHLRPHSQARAKETARQPLLDHCHVTFVTLKCDSSKKRRRGRKSPSKEVSHITAEFEIETKMEEASGTCEADCLRKRAEQSLQAAIKTLRKSIGRQQFYVQVSGTEYEVAQRPAKALEGQGACGAGQVLQDSKCVACGPGTHFGGELGQCVSCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKDQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDGKIHCLHGPLCTAQAGPWRHRDESHVPALRELRPGRYGLTETEGQMQMLGGAV

SEQ ID NO: 17 - DNA, 2992 bp, Homo sapiens
cagcggggcccgcattgagcatgggcgcggcggccgtgcgctggcacttgtgcgtgctgctggccctgggcacacgcgggcggctggccgggggcagcgggctcccagggtcagtcgacgtggatgagtgctcagagggcacagatgactgccacatcgatgccatctgtcagaacgcgcccaagtcctacaaatgcctctgcaagccaggctacaagggggaaggcaagcagtgtggagacattgacgagtgtgagaatgactactacaatgggggctgtgtccacgagtgcatcaacatcccggggaactacaggtgtacctgctttgatggcttcatgctggcacacgatggacacaactgcctggatgtggacgagtgtcaggacaataatggtggctgccagcagatctgcgtcaatgccatgggcagctacgagtgtcagtgccacagtggcttcttccttagtgacaaccagcatacctgcatccaccgctccaatgagggtatgaactgcatgaacaaagaccatggctgtgcccacatctgccgggagacgcccaaaggtggggtggcctgcgactgcaggcccggctttgaccttgcccaaaaccagaaggactgcacactaacctgtaattatggaaacggaggctgccagcacagctgtgaggacacagacacaggccccacgtgtggttgccaccagaagtacgccccccactcagacggtcgcacgtgcatcgagacgtgcgcagtcaataacggaggctgcgaccggacatgcaaggacacagccactggcgtgcgatgcagctgccccgttggattcacactgcagccggacgggaagacatgcaaagacatcaacgagtgcctggtcaacaacggaggctgcgaccacttctgccgcaacaccgtaggcagcttcgagtgcggctgccggaagggctacaagctgctcaccgacgagcgcacctgccaggacatcgacgagtgctccttcgagcggacctgtgaccacatctgcatcaactccccgggcagcttccagtgcctgtgtcaccgcggctacatcctctacgggacaacccactgcggagatgtggacgagtgcagcatgagcaacgggagctgtgaccagggctgcgtcaacaccaagggcagctacgagtgcgtctgtcccccggggaggcggctccactggaaccggaaggattgcgtggagacaggcaagtgtctttctcgcgccaagacctccccccgggcccagctgtcctgcagcaaggcaggcggtgtggagagctgcttcctttcctgcccggctcacacactcttcgtgccagactcggaaaatagctacgtcctgagctgcggagttccagggccgcagggcaaggcgctgcagaaacgcaacggcaccagctctggcctcgggcccagctgctcagatgcccccaccacccccatcaaacagaaggcccgcttcaagatccgagatgccaagtgccacctccggccccacagccaggcacgagcaaaggagaccgccaggcagccgctgctggaccactgccatgtgactttcgtgaccctcaagtgtgactcctccaagaagaggcgccgtggccgcaagtccccatccaaggaggtgtcccacattacagcagagtttgagatcgagacaaagatggaagaggcctcagacacatgcgaagcggactgcttgcggaagcgagcagaacagagcctgcaggccgccatcaagaccctgcgcaagtccatcggccggcagcagttctatgtccaggtctcaggcactgagtacgaggtagcccagaggccagccaaggcgctggaggggcagggggcatgtggcgcaggccaggtgctacaggacagcaaatgcgttgcctgtgggcctggcacccacttcggtggtgagctcggccagtgtgtgccatgtatgccaggaacataccaggacatggaaggccagctcagttgcacaccgtgccccagcagcgacgggcttggtctgcctggtgcccgcaacgtgtcggaatgtggaggccagtgttctccaggcttcttctcggccgatggcttcaagccctgccaggcctgccccgtgggcacgtaccagcctgagcccgggcgcaccggctgcttcccctgtggagggggtttgctcaccaaacacgaaggcaccacctccttccaggactgcgaggctaaagtgcactgctcccccggccaccactacaacaccaccacccaccgctgcatccgctgccccgtcggcacctaccagcccgagtttggccagaaccactgcatcacctgtccgggcaacaccagcacagacttcgatggctccaccaacgtcacacactgcaaaaaccagcactgcggcggcgagcttggtgactacaccggctacatcgagtcccccaactaccctggcgactacccagccaacgctgaatgcgtctggcacatcgcacctcccccaaagcgcaggatcctcatcgtggtccctgagatcttcctgcccatcgaggatgagtgcggcgatgttctggtcatgaggaagagtgcctctcccacgtccatcaccacctatgagacctgccagacctacgagaggcccatcgccttcacctcccgctcccgcaagctctggatccagttcaaatccaatgaaggcaacagcggcaaaggcttccaagtgccctatgtcacctacgatgaggactaccagcaactcatagaggacatcgtgcgcgatgggcgcctgtacgcctcggagaaccaccaggaaattttgaaagacaagaagctgatcaaggccctcttcgacgtgctggcgcatccccagaactacttcaagtacacagcccaggaatccaaggagatgttcccacggtccttcatcaaactgctgcgctccaaagtgtctcggttcctgcggccctacaaataaccggg

SEQ ID NO: 18 - protein, 988 aa, Homo sapiens
MGAAAVRWHLCVLLALGTRGRLAGGSGLPGSVDVDECSEGTDDCHIDAICQNAPKSYKCLCKPGYKGEGKQCGDIDECENDYYNGGCVHECINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPTCGCHQKYAPHSDGRTCIETCAVNNGGCDRTCKDTATGVRCSCPVGFTLQPDGKTCKDINECLVNNGGCDHFCRNTVGSFECGCRKGYKLLTDERTCQDIDECSFERTCDHICINSPGSFQCLCHRGYILYGTTHCGDVDECSMSNGSCDQGCVNTKGSYECVCPPGRRLHWNRKDCVETGKCLSRAKTSPRAQLSCSKAGGVESCFLSCPAHTLFVPDSENSYVLSCGVPGPQGKALQKRNGTSSGLGPSCSDAPTTPIKQKARFKIRDAKCHLRPHSQARAKETARQPLLDHCHVTFVTLKCDSSKKRRRGRKSPSKEVSHITAEFEIETKMEEASDTCEADCLRKRAEQSLQAAIKTLRKSIGRQQFYVQVSGTEYEVAQRPAKALEGQGACGAGQVLQDSKCVACGPGTHFGGELGQCVPCMPGTYQDMEGQLSCTPCPSSDGLGLPGARNVSECGGQCSPGFFSADGFKPCQACPVGTYQPEPGRTGCFPCGGGLLTKHEGTTSFQDCEAKVHCSPGHHYNTTTHRCIRCPVGTYQPEFGQNHCITCPGNTSTDFDGSTNVTHCKNQHCGGELGDYTGYIESPNYPGDYPANAECVWHIAPPPKRRILIVVPEIFLPIEDECGDVLVMRKSASPTSITTYETCQTYERPIAFTSRSRKLWIQFKSNEGNSGKGFQVPYVTYDEDYQQLIEDIVRDGRLYASENHQEILKDKKLIKALFDVLAHPQNYFKYTAQESKEMFPRSFIKLLRSKVSRFLRPYK

SEQ ID NO: 19 - DNA, 1489 bp, Homo sapiens
cagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggtatgtttcaaaatacttaattacaagtttgctgcctcaagtatccagagagtcttgtcaacattaacactagcagtatttccaacactttatttttttaacttcctttattatacagaagcaggatctatgttttttactctttttgcgcatccgatgcgcctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttctttccttagtttggaaacgtagaattctgttttttgtggttaccttagtctctgtgtttttagtttggaaattcacttatgctcataaatacttgctagcagacaatagacattatactttctatgtgtggaaaagagtttttcaaagatatgaaactgtaaaatatttgttagttccagcctatatatttgctggttggagtatagctgactcattgaaatcaaagtcaattttttggaatttaatgtttttcatatgcttgttcactgttatagttcctcagaaactgctggaatttcgttacttcattttaccttatgtcatttataggcttaacatacctctgcctcccacatccagactcatttgtgaactgagctgctatgcagttgttaatttcataacttttttcatctttctgaacaagacttttcagtggccaaatagtcaggacattcaaaggt

SEQ ID NO: 20 - protein, 483 aa, Homo sapiens
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKVCFKILNYKFAASSIQRVLSTLTLAVFPTLYFFNFLYYTEAGSMFFTLFAHPMRLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQRFMW

SEQ ID NO: 21 - DNA, 1461 bp, Homo sapiens
cagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttctttccttagtttggaaacgtagaattctgttttttgtggttaccttagtctctgtgtttttagtttggaaattcacttatgctcataaatacttgctagcagacaatagacattatactttctatgtgtggaaaagagtttttcaaagatatgaaactgtaaaatatttgttagttccagcctatatatttgctggttggagtatagctgactcattgaaatcaaagtcaattttttggaatttaatgtttttcatatgcttgttcactgttatagttcctcagaaactgctggaatttcgttacttcattttaccttatgtcatttataggcttaacatacctctgcctcccacatccagactcatttgtgaactgagctgctatgcagttgttaatttcataacttttttcatctttctgaacaagacttttcagtggccaaatagtcaggacattcaaaggtga

SEQ ID NO: 22 - protein, 470 aa, Homo sapiens
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQR

SEQ ID NO: 23 - DNA, 2068 bp, Homo sapiens
ggatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcgggacgcagggagccagagaagaagatcgtccaggagctgctggagacagagcaggcctatgtggcgcgcctccacctgctagaccaggtgtttttccaggagctgctgaagacagcccgcagcagcaaggccttcccagaggatgtggtcagggtcatcttctccaacatctcctccatctatcagttccattctcagttcttcctcccagagctgcagcggcgcctggacgactggacagctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccagagcagcgaggcttcgggcagcctgaccctgcagcaccacatgctggaaccagtgcagagaattccacgttacgagctgctgctcaaggagtacatccagaagctgccagcccaggccccagaccaggccgatgcccagagagccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgttcaacaacatgctgctctactgtgtgcccagggtgatccaggtgggcgcccagttccaggtgaggacccgcatcgatgtggccgggatgaaggtaagagagctgatggatgctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagccacagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccagggggaccctcgggtcttccagctacagcagtcaggccagctctacaccttcaaggccgagacggaggagctgaagggccgctgggtgaaggccatggagcgggcggccagtggctggagccccagctggcccaacgatggggacctgtccgattgagccactgccagccgctttcctgccctctccctgaaataaagaacagcttgccagaaaaaaaaaaaaaaaaaaaaaa

SEQ ID NO: 24 - protein, 655 aa, Homo sapiens
MKGASEEKLASVSNLVTVFENSRTPEAAPRGQRLEDVHHRPECRPPESPGPREKTNVGEAVGSEPRTVSRRYLNSLKNKLSSEAWRKSCQPVTLSGSGRREPEKKIVQELLETEQAYVARLHLLDQVFFQELLKTARSSKAFPEDVVRVIFSNISSIYQFHSQFFLPELQRRLDDWTANPRIGDVIQKLAPFLKMYSEYVKNFERAAELLATWTDKSPLFQEVLTRIQSSEASGSLTLQHHMLEPVQRIPRYELLLKEYIQKLPAQAPDQADAQRALDMIFSAAQHSNAAITEMERLQDLWEVYQRLGLEDDIVDPSNTLLREGPVLKISFRRNDPMERYLFLFNNMLLYCVPRVIQVGAQFQVRTRIDVAGMKVRELMDAEFPHSFLVSGKQRTLELQARSQEEMISWMQAFQAAIDQIEKRNETFKAAAQGPEGDIQEPQLQSEELGLRAPQWVRDKMVTMCMRCQEPFNALTRRRHHCRACGYVVCARCSDYRAELKYDDNRPNRVCLHCYAFLTGNVLPEAKEDKRRGILEKGSSATPDQSLMCSFLQLIGDKWGKSGPRGWCVIPRDDPLVLYVYAAPQDMRAHTSIPLLGYQVTVGPQGDPRVFQLQQSGQLYTFKAETEELKGRWVKAMERAASGWSPSWPNDGDLSD

SEQ ID NO: 25 - DNA, 2135 bp, Homo sapiens
gggtagctgagatccaccccggaaaccggcaggatgaagggggcaagtgaggagaagctggcatctgtgtccaacctggtcactgtgtttgagaatagcaggaccccagaagcagcacccagaggccagaggctagaggacgtgcatcaccgccctgagtgcaggcctcccgagtccccaggaccacgggagaagacgaatgtcggggaggccgtggggtctgagcccaggacagtcagcaggaggtacctgaactccctgaagaacaagctgtccagcgaagcctggaggaaatcttgccagcctgtgaccctctcaggatcggggacgcaggagccagagaagaagatcgtccaggagctgctggagacagagcaggcctatgtggcgcgcctccacctgctagaccaggtgtttttccaggagctgctgaagacagcccgcagcagcaaggccttcccagaggatgtggtcagggtcatcttctccaacatctcctccatctatcagttccattctcagttcttcctcccagagctgcagcggcgcctggacgactgggctaacccccgcatcggtgacgtgatccagaagctggcccccttcctgaagatgtacagtgagtatgtcaagaactttgagcgagcggctgagctgctggccacctggaccgacaagtctccactcttccaggaggttctcactcgcatccagagcgaggcttcgggcagcctgaccctgcagcaccacatgctggaaccagtgcagagaattccacgttacgagctgctgctcaaggagtacatccagaagctgccagcccaggccccagaccaggccgatgcccaggccctggacatgatcttctcagctgcccagcactccaatgcagccatcactgagatggagcggctgcaggacctgtgggaggtgtaccagcgcctgggcctcgaggacgacatagtagacccctctaacaccctgctccgtgagggcccggtcctcaagatctccttccgccgcaacgaccccatggagcgctaccttttcttgttcaacaacatgctgctctactgtgtgcccagggtgatccaggtgggcgcccagttccaggtgaggacccgcatcgatgtggccgggatgaaggtaagagagctgatggatgctgagtttccccactccttcctggtgtccgggaagcagcgcaccctggagctgcaagcccggtcccaggaggaaatgatttcctggatgcaggccttccaagcagccattgaccaaatcgagaagcggaatgaaaccttcaaggctgcggcccaggggcctgagggagacatccaggagccacagctgcagtctgaggagctgggcctccgggcaccgcagtgggtccgggacaagatggtgaccatgtgcatgcgctgccaggagcccttcaacgctctgacgcgccgtcgccaccactgccgggcctgcggctatgtggtgtgtgccaggtgctccgactaccgggccgaactgaaatacgacgacaacaggcccaaccgagtctgcctccactgctacgcattcctcactggaaatgtgctgcctgaggccaaggaggacaagaggcggggcatcctggagaaagggtcctcagccacgcctgaccagagcctgatgtgcagcttcctgcagctcatcggggacaagtggggcaagagcggcccccggggctggtgtgtgatccctcgggatgaccccctcgtgctctatgtctatgctgcccctcaggacatgagggctcacacctccatccccctgctgggctaccaggtgactgttgggccccaggggccctcgggtcttccagctacagcagtcaggccagctctacaccttcaaggccgagacggaggagctgaagggccgctgggtgaaggccatggagcgggcggccagtggctggagccccagctggcccaacgatggggacctgtccgactgagccactgccagccgctctcctgcccacctctccccaccctgaacccagctcctgccacagactgaccctgtggcctcagtgacccactgccccaagtggtgctttcagagaattgattcagccatctgcgcccaggccacgtgtc

SEQ ID NO: 26 - protein, 673 aa, Homo sapiens
MKGASEEKLASVSNLVTVFENSRTPEAAPRGQRLEDVHHRPECRPPESPGPREKTNVGEAVGSEPRTVSRRYLNSLKNKLSSEAWRKSCQPVTLSGSGTQEPEKKIVQELLETEQAYVARLHLLDQVFFQELLKTARSSKAFPEDVVRVIFSNISSIYQFHSQFFLPELQRRLDDWANPRIGDVIQKLAPFLKMYSEYVKNFERAAELLATWTDKSPLFQEVLTRIQSEASGSLTLQHHMLEPVQRIPRYELLLKEYIQKLPAQAPDQADAQALDMIFSAAQHSNAAITEMERLQDLWEVYQRLGLEDDIVDPSNTLLREGPVLKISFRRNDPMERYLFLFNNMLLYCVPRVIQVGAQFQVRTRIDVAGMKVRELMDAEFPHSFLVSGKQRTLELQARSQEEMISWMQAFQAAIDQIEKRNETFKAAAQGPEGDIQEPQLQSEELGLRAPQWVRDKMVTMCMRCQEPFNALTRRRHHCRACGYVVCARCSDYRAELKYDDNRPNRVCLHCYAFLTGNVLPEAKEDKRRGILEKGSSATPDQSLMCSFLQLIGDKWGKSGPRGWCVIPRDDPLVLYVYAAPQDMRAHTSIPLLGYQVTVGPQGPSGLPATAVRPALHLQGRDGGAEGPLGEGHGAGGQWLEPQLAQRWGPVRLSHCQPLSCPPLPTLNPAPATD

SEQ ID NO: 27 - DNA, 1086 bp, Homo sapiens
cagagtcacggtgactcattcgggggtggccacacttagccaagcaaggcgaactttgatgatcctagggggtcttgctgaaaagactggtagtctttctgctggaattacccacctgggagggtggagcctactgctgccttcatggtggggagtgggtggaggtgggggtgcagtggggggagccgccgcagcagggccgggcgctgggcgggctgctgcgctgggtggtgcaacagatgggattggaaaagcctacgctgaagagttagcaagccgaggtctcaatataatcctgattagtcggaacgaggagaagttgcaggttgttgctaaagacatagccgacacgtacaaagtggaaactgatattatagttgcggacttcagcagcggtcgtgagatctaccttccaattcgagaagccctgaaggacaaagacgttggcatcttggtaaataacgtgggtgtgttttatccctacccgcagtatttcactcagctgtccgaggacaagctctgggacatcataaatgtgaacattgccgccgctagtttgatggtccatgttgtgttaccgggaatggtggagagaaagaaaggtgccatcgtcacgatctcttctggctcctgctgcaaacccactcctcagctggctgcattttctgcttctaaggcttatttagaccacttcagcagagccttgcaatatgaatatgcctctaaaggaatctttgtacagagtctaatccctttctatgtagccaccagcatgacagcacccagcaactttctgcacaggtgctcgtggttggtgccttcgccaaaagtctatgcacatcatgctgtttctactcttgggatttccaaaaggaccacaggatattggtcccattctactcgagcttgggaagtcaaggctgcagtgagctgtgttcacaccactgtactccagcctggcaacaaagtgagaccccgtctcaccaaaaaaaaaaaaaaaaaagagagagagagagaacagtaatctttaaatgtgtaacaatttttaaagcattggcaaagactatgtaaatttcacttctaggt

SEQ ID NO: 28 - protein, 321 aa, Homo sapiens
MILGGLAEKTGSLSAGITHLGGWSLLLPSWWGVGGGGGAVGGAAAAGPGAGRAAALGGATDGIGKAYAEELASRGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSTRAWEVKAAVSCVHTTVLQPGNKVRPRLTKKKKKKEREREQ

SEQ ID NO: 29 - DNA, 2758 bp, Homo sapiens
cggccggaagtggcggcggcggcgtcggcggcggcgtagccgtagaggtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcagtgcctgagattgtgagggagacccaggacctaattgaacaaggggcactcctgcaagcccaccggaagctgatggacctggagtgctcccgggacgggctgatgtacgagcagtaccgcatggacagtgggaacacgcgtgacatgaccctcatccatggctactttggcagcacgcaggggctctctgatgagctggctaagcagctgtggatggtgctgcagaggtcactggtcactgtccgccgtgaccccaccttgctggtctcagttgtcaggatcattgaaagggaagagaaaattgacaggcgcatacttgaccggaaaaagcaaactggctttgttcctcctgggaggcccaagaattggaaggagaaaatgttcaccatcttggagaggactgtgaccaccagaattgagggcacacaggcagataccagagagtctgacaagatgtggcttgtccgccacctggaaattataaggaagtacgtcctggatgacctcattgtcgccaaaaacctgatggttcagtgctttcctccccactatgagatctttaagaacctcctgaacatgtaccaccaagccctgagcacgcggatgcaggacctcgcatcggaagacctggaagccaatgagatcgtgagcctcttgacgtgggtcttaaacacctacacaagtactgagatgatgaggaacgtggagctggccccggaagtggatgtcggcaccctggagccattgctttctccacacgtggtctctgagctgcttgacacgtacatgtccacgctcacttcaaacatcatcgcctggctgcggaaagcgctggagacagacaagaaagactgggtcaaagagacagagccagaagccgaccaggacgggtactaccagaccacactccctgccattgtcttccagatgtttgaacagaatcttcaagttgctgctcagataagtgaagatttgaaaacaaaggtactagttttatgtcttcagcagatgaattctttcctaagcagatataaagatgaagcgcagctgtataaagaagagcacctgaggaatcggcagcaccctcactgctacgttcagtacatgatcgccatcatcaacaactgccagaccttcaaggaatccatagtcagtttaaaaagaaagtatttaaagaatgaagtggaagagggtgtgtctccgagccagcccagcatggacgggattttagacgccatcgcgaaggagggctgcagcggtttgctggaggaggtcttcctggacctggagcaacatctgaatgaattgatgacgaagaagtggctattagggtcaaacgctgtagacattatctgtgtcaccgtggaagactatttcaacgattttgccaaaattaaaaagccgtataagaagaggatgacggccgaggcgcaccggcgcgtggtggtggagtacctgcgggcggtcatgcagaagcgcatttccttccggagcccggaggagcgcaaggagggtgccgagaagatggttagggaggcagagcagcggcgcttcctgttccggaagctggcgtccggtttcggggaagacgtggacggatactgcgacaccatcgtggctgtggccgaagtgatcaagctgacagacccttctctgctctacctggaggtctccactctggtcagcaagtatccagacatcagggatgaccacatcggtgcgctgctggctgtgcgtggggacgccagccgtgacatgaagcagaccatcatggagaccctggagcagggcccagcacaggccagccccagctacgtgcccctcttcaaggacattgtggtgcccagcctgaacgtggccaagctgctcaagtagcctccgccggcctgccctgctcgcccctccacagcctcggtccctgcctttagaaacgcgggacagctgattgctctccttggccacacgtgctccttttagctgcacggcctgtctttaggtgccagtgtgatgcaccgggtgtgcgtcgagtgagcgtcccgaggccacgtgcggaggcccctcactgtgctgtcaaaggcctgtgggtgcagggctctgccgcacagcctctcttgggtgcttgtttgttgcagtggttgaaagtgtgtggggcacagaggacgtgcacctccctgccctcctcctccctgggccttcaccgcaccccatctgcttaagtgctcggaaccccgtcacctaattaaagtttctcggcttcctcagagaaaaaaaaaaaaaaaaaaaaaaaaaaa

SEQ ID NO: 30 - protein, 745 aa, Homo sapiens
MKETDREAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMYEQYRMDSGNTRDMTLIHGYFGSTQGLSDELAKQLWMVLQRSLVTVRRDPTLLVSVVRIIEREEKIDRRILDRKKQTGFVPPGRPKNWKEKMFTILERTVTTRIEGTQADTRESDKMWLVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQRRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 31 - DNA, 1609 bp, Homo sapiens
tttctggcctccccaccatgagccgccaattcacctacaagtcgggagctgctgccaaggggggcttcagcggctgctccgctgtgctctcagggggcagctcatcctcctaccgagcagggggcaaagggctcagtggaggcttcagcagtcggagcctttacagcctggggggtgcccggagcatctctttcaatgtggccagtggcagtgggtgggcaggaggctatggatttggccggggccgggccagtggctttgctggcagcatgtttggcagtgtggccttggggtccgtgtgtccgtcgttgtgcccgcccgggggtatccatcaggtcaccatcaacaagagcctcctggcacccctgaacgtggagctggaccctgaaatccagaaagtgcgtgcccaggagcgggagcagatcaaggtgctgaacaacaagttcgcctccttcattgacaaggtgcggttcctggagcagcagaaccaggtgctggagaccaagtgggagctgctacagcagctggacctgaacaactgcaagaataacctggagcccatccttgagggctacatcagcaacctgcggaagcagctggagacgctgtctggggacagggtgaggctggactcggagctgaggagcgtgcgcgaagtggtggaggactacaagaagaggtatgaagaagaaataaacaagcgcacaactgctgagaatgaatttgtggtgcttaagaaggacgtggacgcagcttacacgagcaaagtggagctgcaggccaaggtggatgccctggatggagaaatcaagttcttcaagtgtttgtttcccctgcaggagactgctcagatccagtcccacatcagcgacacgtccatcatcctgtccatggacaacaaccggaacctggacctggacagcatcattgctgaggtccgtgcccagtatgaggagatcgcccggaagagcaaggccgaggccgaggccctgtaccagaccaagttccaggagctgcagctagcagccggccggcatggggatgacctgaaacacaccaaaaatgagatctcagagctgacccgtctcatccaaagactgcgctcggagattgagagtgtgaagaagcagtgtgccaacctggagacggccatcgctgacgccgagcagcggggggactgtgccctcaaggatgccagggccaagctggatgagctggagggcgccctgcaccaggccaaggaggagctggcacggatgctgcgcgagtaccaggagctcatgagcctgaagctggccctggacatggagatcgccacctatcgcaagctactggagagcgaggagtgcaggatgtcaggagaatttccctcccctgtcagcatcgccatcatcagcagcaccagtggcggcagtgtctatggcttccggcccagcatggtcagcggtggctatgtggccaacagcagcaactgcatctctggagtgtgcagcgtgagaggcggggagggcaggagccggggcagtgccaacgattacaaagacaccctagggaagggttccagcctgagtgcaccctccaagaaaaccagtcggtagagaagactgcc

SEQ ID NO: 32 - protein, 526 aa, Homo sapiens
MSRQFTYKSGAAAKGGFSGCSAVLSGGSSSSYRAGGKGLSGGFSSRSLYSLGGARSISFNVASGSGWAGGYGFGRGRASGFAGSMFGSVALGSVCPSLCPPGGIHQVTINKSLLAPLNVELDPEIQKVRAQEREQIKVLNNKFASFIDKVRFLEQQNQVLETKWELLQQLDLNNCKNNLEPILEGYISNLRKQLETLSGDRVRLDSELRSVREVVEDYKKRYEEEINKRTTAENEFVVLKKDVDAAYTSKVELQAKVDALDGEIKFFKCLFPLQETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGALHQAKEELARMLREYQELMSLKLALDMEIATYRKLLESEECRMSGEFPSPVSIAIISSTSGGSVYGFRPSMVSGGYVANSSNCISGVCSVRGGEGRSRGSANDYKDTLGKGSSLSAPSKKTSR

SEQ ID NO: 33 - DNA, 876 bp, Homo sapiens
atggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacatcataaagctttaccaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcagattttggatttgggaatttctacaagtcaggagagcctctgtccacgtggtgtgggagccccccgtatgccgccccggaagtctttgaggggaaggagtatgaaggcccccagctggacatctggagcctgggcgtggtgctgtacgtcctggtctgcggttctctccccttcgatgggcctaacctgccgacgctgagacagcgggtgctggagggccgcttccgcatccccttcttcatgtctcaagactgtgagagcctgatccgcctggccaggctggccccaggttgtgagcccctggggctgctgcagggggactgtgagatgggggacctgatgccctgctccctaggcacgtttgtcctggtgcagtga

SEQ ID NO: 34 - protein, 291 aa, Homo sapiens
MVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIRLARLAPGCEPLGLLQGDCEMGDLMPCSLGTFVLVQ

SEQ ID NO: 35 - DNA, 2693 bp, Homo sapiens
gtggggtcgtatcccgcgggtggaggccggggtggcgccggccggggcgggggagcccaaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaagaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgctcttccttgggtatgaatgtgtgagttcacccagaggcctgctctcctcacacattgtgtggtttggggttaatgatggagggagacacctcttcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttcaaaaaaaaaaaaaaaaaaaaaaaaaaaaaaaaaa

SEQ ID NO: 36 - protein, 467 aa, Homo sapiens
MQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 37 - DNA, 2648 bp, Homo sapiens
gtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcggtggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaggagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgctcttccttgggtatgaatgtgtgagttcacccagaggcctgctctcctcacacattgtgtggtttggggttaatgatggagggagacacctcttcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttcaaaaaaaaaaaaaaaaaaaaaaaaaaaaaaaaaa

SEQ ID NO: 38 - protein, 446 aa, Homo sapiens
MKKGIRYETSRKTSYIFQQPQHGPWQTRMRKISNHGSLRVAVARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKGVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 39 - DNA, 1515 bp, Homo sapiens
atggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcggctgagtaagaagtacggaccggtgttcaccatctacctgggaccgtggcggcctgtggtggtcctggttgggcaggaggctgtgcgggaggccctgggaggtcaggctgaggagttcagcggccggggaaccgtagcgatgctggaagggacttttgatggccatggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaaagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccagggcacggaggtcttccccctccttggctccatcctgcatgaccccaacatcttcaagcacccagaagagttcaacccagaccgtttcctggatgcagatggacggttcaggaagcatgaggcgttcctgcccttctccttagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatga

SEQ ID NO: 40 - protein, 505 aa, Homo sapiens
  VARIANT (505): wherein Xaa is any amino acid
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTRX

SEQ ID NO: 41 - DNA, 1185 bp, Homo sapiens
atgggtatcaaagaggggtttgagttttggggacctaggccgtgttgccgcccgctgtgctatgagcagtcagagcgccgtctccacaagagtttacaaatgaaaatggaggaaatgtctttgtctggcctggataacagcaaactagagatgttctcccctggggcccaggccatcgctcaggagatatacgcggacctggtcgaggattcttgtttgggattctgctttgaggtacaccgggctgtcaagtgtggctacttcttcttggacgacacggaccctgatagcatgaaggattttgagatcgtggaccagccgggcttggacatctttggacaggttttcaaccagtggaagagcaaggagtgtgtttgccccaattgcagtcgcagcattgccgcctcccgctttgctccccatctggagaagtgcctgggaatgggtcggaacagcagccgaatcgccaaccgccggattgccaatagcaacaatatgaataagtctgagagtgaccaagaagataatgatgacatcaatgacaacgactggtcctatggctcggagaagaaagccaagaagagaaagtcagacaagctatggtatctcccattccagaaccccaattcccctcgaagatccaagtcattaaaacacaaaaatggggaacttagcaattcggatccttttaagtataacaattcaactgggatcagctatgagaccctggggccggaggagcttcgcagcctgctaaccacgcaatgtggggtgatttctgaacacaccaagaagatgtgcacaaggtccctgcgctgcccacagcacacagatgagcagaggcgaaccgtacggatttattttctcgggccctcggctgtccttccagaggtcgagagctccctggataatgacagctttgacatgactgacagccaggccctgatcagccggcttcagtgggacggctcctctgacctctcaccctctgattcaggctcctccaagacgagtgaaaatcagggatggggtctaggtaccaacagctctgagtcacggaaaaccaagaaaaagaaatcccatctgagcctggtagggactgcctccggcctaggttccaacaagaagaagaagccaaagccaccggcacccccgacgcccagcatctatgatgacatcaactga

SEQ ID NO: 42 - protein, 394 aa, Homo sapiens
MGIKEGFEFWGPRPCCRPLCYEQSERRLHKSLQMKMEEMSLSGLDNSKLEMFSPGAQAIAQEIYADLVEDSCLGFCFEVHRAVKCGYFFLDDTDPDSMKDFEIVDQPGLDIFGQVFNQWKSKECVCPNCSRSIAASRFAPHLEKCLGMGRNSSRIANRRIANSNNMNKSESDQEDNDDINDNDWSYGSEKKAKKRKSDKLWYLPFQNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 43 - DNA, 2193 bp, Homo sapiens
atggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggtggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccgtagtccccgcaacctcatctactttggggagcaccctttgtcctttgctgcctgtgtgaacagcgaggagatcgtgcggctgctcattgagcatggagctgacatcagggcccaggactccctgggaaacacagtattacacatcctcatcctccagcccaacaaaacctttgcctgccagatgtacaacctgctgctgtcctacgatggacatggggaccacctgcagcccctggaccttgtgcccaatcaccagggtctcacccccttcaagctggctggagtggagggtaacactgtgatgttccagcacctgatgcagaagcggaggcacatccagtggacgtatggacccctgacctccattctctacgacctcacagagatcgactcctggggagaggagctgtccttcctggagcttgtggtctcctctgataaacgagaggctcgccaaattctggaacagaccccagtgaaggagctggtgagcttcaagtggaacaagtatggccggccgtacttctgcatcctggctgccttgtacctgctctacatgatctgctttaccacgtgctgcgtctaccgcccccttaagtttcgtggtggcaaccgcactcattctcgagacatcaccatcctccagcaaaaactactacaggaggcctatgagacacgtgaagatatcatcaggctggtgggggagctggtgagcatcgttggggctgtgatcatcctgctcctagagattccagacatcttcagggttggtgcctctcgctattttggaaagacgattcttggggggccattccatgtcatcatgatcacctatgcctccctggtgctggtgaccatggtgatgcggctcaccaacaccaatggggaggtggtgcccatgtcctttgccctggtgctgggctggtgcagtgtcatgtatttcactcgaggattccagatgctgggtcccttcaccatcatgatccagaagatgatttttggagacctaatgcgtttctgctggctgatggctgtggtcatcttgggatttgcctccgcgttctatatcattttccagacagaggacccaaccagtctggggcaattctatgactaccccatggcactgttcaccacctttgagctttttctcactgttattgatgcacctgccaactacgacgtggacttgcccttcatgttcagcattgtcaacttcgccttcgccatcattgccacactgctcatgctcaacttgttcatcgccatgatgggcgacacccactggagggtggcccaggagagggatgagctctggagggcccaggtcgtggccaccacagtgatgctggagcggaagctgcctcgctgcctgtggcctcgctccgggatctgtgggtgcgaattcgggctgggggaccgctggttcctgcgggttgagaaccacaatgatcagaatcctctgcgagtgcttcgctatgtggaagtgttcaagaactcagacaaggaggatgaccaggagcatccatctgagaaacagccctctggggctgagagtgggactctagccagagcctctttggctcttccaacttcctccctgtcccggaccgcgtcccagagcagcagtcaccgaggctgggagatccttcgtcaaaacaccctggggcacttgaatcttggactgaaccttagtgagggggatggagaggaggtctaccatttttga

SEQ ID NO: 44 - protein, 730 aa, Homo sapiens
MGGFLPKAEGPGSQLQKLLPSFLVREQDWDQHLDKLHMLQQKRILESPLLRASKENDLSVLRQLLLDCTCDVRQRGGALGETALHIAALYDNLEAALVLMEAAPELVFEPTTCEAFAGQTALHIAVVNQNVNLVRALLTRRASVSARATGTAFRRSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIMITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFAIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 45 - DNA, 847 bp, Homo sapiens
atggcggacctgagcttcatcgaagataccgtcgccttccccgagaaggaagaggatgaggaggaagaagaggagggtgtggagtggggctacgaggaaggtgttgagtggggtctggtgtttcctgatgctaatggggaataccagtctcctattaacctaaactcaagagaggctaggtatgacccctcgctgttggatgtccgcctctccccaaattatgtggtgtgccgagactgtgaagtcaccaatgatggacacaccattcaggttatcctgaagtcaaaatcagttctttcgggaggaccattgcctcaagggcatgaatttgaactgtacgaagtgagatttcactggggaagagaaaaccagcgtggttctgagcacacggttaatttcaaagcttttcccatggagataggaaaggaacatgttggcttgaaggctgtgactgaaatcctccaagatattcagtataaggggaagtccaaaacaataccttgctttaatcctaacactttattaccagaccctctgctgcgggattactgggtgtatgaaggctctctcaccatcccaccttgcagtgaaggtgtcacctggatattattccgataccctttaactatatcccagctacagatagaagaatttcgaaggctgaggacacatgttaagggggcagaacttgtggaaggctgtgatgggattttgggagacaactttcggcccactcagcctcttagtgacagagtcattagagctgcatttcagtagccaaagaggacaggaacaagtctgtcttcatgagggaggaagacaatggtctataatgcccttggataag

SEQ ID NO: 46 - protein, 258 aa, Homo sapiens
MADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMEIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 47 - DNA, 847 bp, Homo sapiens; identical to SEQ ID NO: 45

SEQ ID NO: 48 - protein, 258 aa, Homo sapiens; identical to SEQ ID NO: 46

SEQ ID NO: 49 - DNA, 354 bp, Homo sapiens
atgaagttccagtacaaggaggtccatccctttgagtatcggaaaaaggaaggagaaaagatccggaagaaatatccggacagggtccccttgattgtagagaaggctccaaaagcaagggtgcctgatctggacaggaggaagtacctagtgccctccgaccttaccgatggccagttctaccttttaatccggaagagaatccacctgagacctgaggacgccttattcttctttgtcaacaacactatccctcccactagtgctaccatgggccaactatatgaggacagtcatgaggaagatgattttctgtatgtggcctacagtaatgagagtgtctatgggaaatga

SEQ ID NO: 50 - protein, 117 aa, Homo sapiens
MKFQYKEVHPFEYRKKEGEKIRKKYPDRVPLIVEKAPKARVPDLDRRKYLVPSDLTDGQFYLLIRKRIHLRPEDALFFFVNNTIPPTSATMGQLYEDSHEEDDFLYVAYSNESVYGK

SEQ ID NO: 51 - DNA, 417 bp, Homo sapiens
gatcacggaagccctgtgattcaccatgaagttccagtacaaggaggtccatccctttgagtatcggaaaaaggaaggagaaaagatccggaagaaatatccggacagggtccccttgattgtagagaaggctccaaaagcaagggtgcctgatctggacaggaggaagtacctagtgccctccgaccttaccgatggccagttctaccttttaatccggaagagaatccacctgagacctgaggacgccttattcttctttgtcaacaacactatccctcccactagtgctaccatgggccaactatatgaggacagtcatgaggaagatgattttctgtatgtggcctacagtaatgagagtgtctatgggaaatgagtggttggaagcccagcagatgggaagcacctggactt

SEQ ID NO: 52 - protein, 117 aa, Homo sapiens; identical to SEQ ID NO: 50

SEQ ID NO: 53 - protein, 618 aa, Homo sapiens
MDPMNIDTGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLSLSTGGSMILGRQQPATEKRGSIVRFMPDSPQVPNDNSGPDQHTLSQNFGFSFIPEGGMNPPINANASFIP

SEQ ID NO: 54 - protein, 452 aa, Homo sapiens
MLGITIGHMGGDIMNSDLLQGKDTPLTYLVSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGNPAVR

SEQ ID NO: 55 - protein, 641 aa, Homo sapiens
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGNPAVR

SEQ ID NO: 56 - protein, 641 aa, Mus musculus
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVAQAMKTKETRVLPPVPVPQRVGVSGGDPEDMEIKKKRDKIKEMMKHAWDNYRTYGWGHNELRPIARKGHSTNIFGSSQMGATIVDALDTLYIMGLHDEFMDGQRWIEENLDFSVNSEVSVFEVNIRFIGGLLAAYYLSGEEIFKTKAVQLAEKLLPAFNTPTGIPWAMVNLKSGVGRNWGWASAGSSILAEFGTLHMEFVHLSYLTGDLTYYNKVMHIRKLLQKMERPNGLYPNYLNPRTGRWGQYHTSVGGLGDSFYEYLLKAWLMSDKTDHEARRMYDDAVEAIEKHLIKKSRGGLVFIGEWKNGHLERKMGHLACFAGGMFALGADGSRKDKAGHYLELGAEIARTCHESYDRTALKLGPESFKFDGAVEAVAVRQAEKYYILRPEVIETYWYLWRFTHDPRYRQWGWEAALAIEKSCRVSGGFSGVKDVYAPTPVHDDVQQSFFLAETLKYLYLLFSGDDLLPLDHWVFNTEAHPLPVLRLANSTLSGNPAVR

SEQ ID NO: 57 - protein, 641 aa, Mus musculus
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVAQAMKTKETRVLPPVPVPQRVGVSGGDPEDMEIKKKRDKIKEMMKHAWDNYRTYGWGHNELRPIARKGHSTNIFGSSQMGATIVDALDTLYIMGLHDEFMDGQRWIEENLDFSVNSEVSVFEVNIRFIGGLLAAYYLSGEEIFKTKAVQLAEKLLPAFNTPTGIPWAMVNLKSGVGRNWGWASAGSSILAEFGTLHMEFVHLSYLTGDLTYYNKVMHIRKLLQKMERPNGLYPNYLNPRTGRWGQYHTSVGGLGDSFYEYLLKAWLTSDKTDHEARRMYDDAVEAIEKHLIKKSRGGLVFIGEWKNGHLERKMGHLACFAGGMLALGADGSRKDKAGHYLELGAEIARTCHESYDRTALKLGPESFKFDGAVEAVAVRQAEKYYILRPEVIETYWYLWRFTHDPRYRQWGWEAALAIEKSCRVSGGFSGVKDVYAPTPVHDDVQQSFSLAETLKYLYLLFSGDDLLPLDHWVFNTEAHPLPVLRLANSTLSGNPAVR

SEQ ID NO: 58 - protein, 827 aa, Homo sapiens
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFRFDTSFMYMIAGLCMLKLYQTRHPDINASAYSAYASFAVVIMVTVLGVVFGKNDVWFWVIFSAIHVLASLALSTQIYYMGRFKIDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 59 - protein, 512 aa, Homo sapiens
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLRPSTTFSAIWATCFWASSSC

SEQ ID NO: 60 - protein, 845 aa, Homo sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGHDQFKRRLPSGQMRQLCIAMGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVSGPPGAALRIT

SEQ ID NO: 61 - protein, 456 aa, Homo sapiens
MRQLCIAMGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVSGPPGRAGWVREGSSCLLPCG

SEQ ID NO: 62 - protein, 392 aa, Mus musculus
VLRKKYQIYFWNIATIAVFYALPVVQLVITYQTVVNVTGNQDICYYNFLCAHPLGNLSAFNNILSNLGYILLGLLFLLIILQREINHNRALLRNDLYALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSVIHIISTLLLSTQLYYMGRWKLDSGIFRRILHVLYTDCIRQCSGPLYTDRMVLLVMGNIINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 63 - protein, 206 aa, Mus musculus
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRADQWNVNYVETSAKTRANVDKVFFDLMREIRARKMEDSKEKNGKKKRKSLAKRIRERCCIL

SEQ ID NO: 64 - protein, 206 aa, Homo sapiens
MAANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRAEQWNVNYVETSAKTRANVDKVFFDLMREIRARKMEDSKEKNGKKKRKSLAKRIRERCCIL

SEQ ID NO: 65 - protein, 206 aa, Mus musculus
MAANKPKGQNSLALHKVIMVGSGGVGKSALTLQFMYDEFVEDYEPTKADSYRKKVVPDGEEVQIDILDTAGQEDYAAIRDNYFRSGEGFLCVFSITEMESFAATADFREQILRVKEDENVPFLLVGNKSDLEDKRQVSVEEAKNRADQWNVNYVETSAKTRANVDKVFFDLMREIRARKMEDSKEKNGKKKRKSLAKRIRERCYIL

SEQ ID NO: 66 - protein, 209 aa, Homo sapiens
MVDYLANKPKGQNSLALHKVIMVGSGGVGKSALTLQFMYDEFVEDYEPTKADSYRKKVVLDGEEVQIDILDTAGQEDYAAIRDNYFRSGEGFLCVFSITEMESFAATADFREQILRVKEDENVPFLLVGNKSDLEDKRQVSVEEAKNRAEQWNVNYVETSAKTRANVDKVFFDLMREIRARKMEDSKEKNGKKKRKSLAKRIRERCCIL

SEQ ID NO: 67 - protein, 206 aa, Xenopus laevis
MAANKPKGQNSLALHKVIMVGSGGVGKSALTLQFMYDEFVEDYEPTKADSYRKKVVLDGVEVQIDILDTAGQEDYAAIRDNYFRSGEGFLCVFSITEQESFAATADFREQILRVKEDENVPFLLVGNKSDLEDKRQVSVEEAKSRADQWNVNYVETSAKTRANVDKVFFDLMREIRARKMEDSKEKNGKKKRKSLAKRIRERCCIL

SEQ ID NO: 68 - protein, 221 aa, Bacteriophage lambda
MRYYEKIDGSKYRNIWVVGDLHGCYTNLMNKLDTIGFDNKKDLLISVGDLVDRGAENVECLELITFPWFRAVRGNHEQMMIDGLSERGNVNHWLLNGGGWFFNLDYDKEILAKALAHKADELPLIIELVSKDKKYVICHADYPFDEYEFGKPVDHQQVIWNRERISNSQNGIVKEIKGADTFIFGHTPAVKPLKFANQMYIDTGAVFCGNLTLIQVQGAGA

SEQ ID NO: 69 - protein, 221 aa, Bacteriophage lambda
MRYYEKIDGSKYRNIWVVGDLHGCYTNLMNKLDTIGFDNKKDLLISVGDLVDRGAENVECLELITFPWFRAVRGNHEQMMIDGLSERGNVNHWLLNGGGWFFNLDYDKEILAKALAHKADELPLIIELVSKDKKYVICHADYPFDEYEFGKPVDHQQVIWNRERISNSQNGIVKEIKGADTFIFGHTPAVKPLKFANQMYIDTGAVFCGNLTLIQVQGEGA

SEQ ID NO: 70 - protein, 221 aa, Escherichia coli
MNIYERIDGSKYRNIWVVGDLHGCYTNLMKKLETIGFDTKKDLLISVGDLVDRGTENVECLELITFPWFRAVRGNHEQMMIDGLSERGNVNHWLLNGGGWFFNLDYDKEILAKALAHKADELPLIIELVSKGKKYVICHADYPCDKYEFGKPVDHQQVIWNRERISNSQDGIVKEIKGADTFIFGHTPAVKPLKFANQMYIDTGAVFCGNLTLIQVQGEGA

SEQ ID NO: 71 - protein, 216 aa, Salmonella typhimurium
MMRPEEIYQRIEAKNWRHVWVVGDIHGCFSMLMKRLRECRFDPQQDLLVSVGDLIDRGPDSLGCLALLRESWMTAVRGNHEQMALDARASSQSTLWLMNGGDWFTRLTAEHAAQAEALFILCQRLPWILEVRCRHSTHVIAHADYPASTYQWQKKVDLHQVLWSRERLINKRGGISGADHFWFGHTPLRRRMDFANVHYIDTGAVFGGQLTLARIQ

SEQ ID NO: 72 - protein, 216 aa, Salmonella enterica
MMRPEEIYQRIEAKNWRHVWVVGDIHGCFSMLMKRLRECQFDPQQDLLVSVGDLIDRGPDSLGCLALLRESWMTAVRGNHEQMALDARASSQSTLWLMNGGDWFTRLTAEHAAQAEALFILCQRLPWILEVRCRHSTHVIAHADYPASTYQWQKKVDLHQVLWSRERLINKRGGISGADHFWFGHTPLRRRMDFANIHYIDTGAVFGGQLTLARIQ

SEQ ID NO: 73 - protein, 482 aa, Homo sapiens
MDEGIPHLQERQLLEHRDFIGLDYSSLYMCKPKRSMKRDDTKDTYKLPHRLIEKKRRDRINECIAQLKDLLPEHLKLTTLGHLEKAVVLELTLKHLKALTALTEQQHQKIIALQNGERSLKSPIQSDLDAFHSGFQTCAKEVLQYLSRFESWTPREPRCVQLINHLHAVATQFLPTPQLLTQQVPLSKGTGAPSAAGSAAAPCLERAGQKLEPLAYCVPVIQRTQPSAELAAENDTDTDSGYGGEAEARPDREKGKGAGASRVTIKQEPPGEDSPAPKRMKLDSRGGGSGGGPGGGAAAAAAALLGPDPAAAAALLRPDAALLSSLVAFGGGGGAPFPQPAAAAAPFCLPFCFLSPSAAAAYVQPFLDKSGLEKYLYPAAAAAPFPLLYPGIPAPAAAAAAAAAAAAAAAAFPCLSSVLSPPPEKAGAAAATLLPHEVAPLGAPHPQHPHGRTHLPFAGPREPGNPESSAQEDPSQPGKEAP

SEQ ID NO: 74 - protein, 410 aa, Mus musculus
MDEGIPHLQERQLLEHRDFIGLDYSSLYMCKPKRSLKRDDTKDTYKLPHRLIEKKRRDRINECIAQLKDLLPEHLKLTTLGHLEKAVVLELTLKHLKALTALTEQQHQKIIALQNGERSLKSPVQADLDAFHSGFQTCAKEVLQYLARFESWTPREPRCAQLVSHLHAVATQLLTPQVPSGRGSGRAPCSAGAAAASGPERVARCVPVIQRTQPGTEPEHDTDTDSGYGGEAEQGRAAVKQEPPGDSSPAPKRPKLEARGALLGPEPALLGSLVALGGGAPFAQPAAAPFCLPFYLLSPSAAAYVQPWLDKSGLDKYLYPAAAAPFPLLYPGIPAAAAAAAAAAFPCLSSVLSPPPEKAGATAGAPFLAHEVAPPGPLRPQHAHSRTHLPRAVNPESSQEDATQPAKDAP

SEQ ID NO: 75 - protein, 253 aa, Rattus norvegicus
MDEGIPHLQERQLLEHRDFIGLDYSSLYMCKPKRSLKRDDTKDTYKLPHRLIEKKRRDRINECIAQLKDLLPEHLKLTTLGHLEKAVVLELTLKHLKALTALTEQQHQKIIALQNGERSLKSPVQADLDAFHSGFQTCAKEVLQYLARFESWTPREPRCAQLVSHLHAVATQLLTPQVTPGRGPGRAPCSAGAAAASGSERVARCVPVIQRTQPGTEPEHDTDTDSGYGGEAEQGRAAVKQEPPGDPSLRPRG

SEQ ID NO: 76 - protein, 404 aa, Mus musculus
QPPPTCLPKAPGLEHGDLSGMDFAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGDLSGRNLEAGQEMFCSGFQTCAREVLQYLAKHENTRDLKSSQLVTHLHRVVSELLQGGASRKPLDSAPKAVDLKEKPSFLAKGSEGPGKNCVPVIQRTFAPSGGEQSGSDTDTDSGYGGELEKGDLRSEQPYFKSDHGRRFAVGERVSTIKQESEEPPTTKSRMQLSEEEGHFAGSDLMGSPFLGPHPHQPPFCLPFYLIPPSATAYLPMLEKCWYPTSVPVLYPGLNTSAAALSSFMNPDKIPTPLLLPQRLPSPLAHSSLDSSALLQALKQIPPLNLETKD

SEQ ID NO: 77 - protein, 411 aa, Mus musculus
MERIPSAQPPPTCLPKAPGLEHGDLSGMDFAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGDLSGRNLEAGQEMFCSGFQTCAREVLQYLAKHENTRDLKSSQLVTHLHRVVSELLQGGASRKPLDSAPKAVDLKEKPSFLAKGSEGPGKNCVPVIQRTFAPSGGEQSGSDTDTDSGYGGELEKGDLRSEQPYFKSDHGRRFAVGERVSTIKQESEEPPTKKSRMQLSEEEGHFAGSDLMGSPFLGPHPHQPPFCLPFYLIPPSATAYLPMLEKCWYPTSVPVLYPGLNTSAAALSSFMNPDKIPTPLLLPQRLPSPLAHSSLDSSALLQALKQIPPLNLETKD

SEQ ID NO: 78 - protein, 523 aa, Rattus norvegicus
MSFRKEDGVSSLCQKALHIITELCFAGQVEWDKCSGIFPADRSGQGGGGTDISVSLLAVVVSFCGLALLVVSLFVFWKLCWPCWKSKLVAPNVSTLPQSISSAPTEVFETEEKKEVEENEKPAPKAIEPAIKISHTSPDIPAEVQTALKEHLIKHARVQRQTTDPTSSSRHNSFRRHLPRQMNVSSVDFSMGTEPVLQRGETRTSIGRIKPELYKQKSVDSEGNRKDDVKTCGKLNFALQYDYENELLVVKIIKALDLPAKDFTGTSDPYVKIYLLPDRKKKFQTRVHRKTLNPLFDELFQFPVVYDQLSNRKLHFSIYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLCIAVMDYDRVGHNEVIGVCRTGLDAEGLGRDHWNEMLAYHRKPITHWHPLLELPGRATSFDSQGSCSSPRPPSTP

SEQ ID NO: 79 - protein, 523 aa, Mus musculus
MSFRKEDGVSSLCQKALHIITELCFAGQVEWDKCSGIFPADRSGQGGGGTDISVSLLAVVVSFCGLALLVVSLFVFWKLCWPCWKSKLVAPNLSVLPQSISSAPTEVFETEEKKEVEENEKPAPKAIEPAIKISHTSPDIPAEVQTALKEHLIKHARVQRQTTEPTSSSRHNSFRRHLPRQMNVSSVDFSVGTEPILQRGETRTSIGRIKPELYKQKSVDSEGNRKDDVKTCGKLNFALQYDYENELLVVKIIKALDLPAKDFTGTSDPYVKIYLLPDRKKKFQTRVHRKTLNPLFDELFQFPVVYDQLSNRKLHFSIYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLCIAVMDYDRVGHNEVIGVCRTGLDAEGLGRDHWNEMLAYHRKPITHWHPLLELPGRATSFDSQGSCSSPRPPSTP

SEQ ID NO: 80 - protein, 498 aa, Rattus norvegicus
MSFRKEDGVSSLCQKALHIITELCFAGQVEWDKCSGIFPADRSGQGGGGTDISVSLLAVVVSFCGLALLVVSLFVFWKLCWPCWKSKLVAPNVSTLPQSISSAPTEVFETEEKKEVEENEKPAPKAIEPAIKISHTSPDIPAEVQTALKEHLIKHARVQRQTTDPTSSSRHNSFRRHLPRQMNVSSVDFSMGTEPVLQRGETRTSIGRIKPELYKQKSVDSEGNRKDDVKTCGKLNFALQYDYENELLVVKIIKALDLPAKDSTGTSDPYVKIYLLPDRKKKFQTRVHRKTLNPLFDELFQFPVVYDQLSNRKLHFSIYDFDRFSRHDMIGEVILDNLFEVSDLSREATVWKDIHCATTESMDLGEIMFSLCYLPTAGRMTLTVIKCRNLKAMDITGSSDPYVKVSLMCEGRRLKKRKTTTKKNTLNPVYNEAIIFDIPPENVDQVSLCIAVMDYDRVGHNEVIGVCRTGLDAEGLGRDHWNEMLAYHRKPITHWHPL

SEQ ID NO: 81 - protein, 511 aa, Mus musculus
MSGVWGAGGPRCQAALAVLASLCRARPPPLGLDVETCRSFELQSPEQSPSAADSGTSVSLLAVVVIVCGVALVAVFLFLFWKLCWMPWRKKEASSPSSANPASETLQSPSSRGNMADKLKDPSALGFLEAAVKISHTSPDIPAEVQMSVKEHIMRHTKLQRQTTEPASSTRHTSFKRHLPRQMHVSSVDYGNELPPAAAEQPTSIGRIKPELYKQKSVDGDDAKSEAAKSCGKINFSLRYDYESETLIVRILKAFDLPAKDFCGSSDPYVKIYLLPDRKCKLQTRVHRKTLNPTFDENFHFPVPYEELADRKLHLSVFDFDRFSRHDMIGEVILDNLFEASDLSRETSIWKDIQYATSESVDLGEIMFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGINAEGLGRDHWNEMLAYPRKPIAHWHSLVEVKKSFKEGTPRL

SEQ ID NO: 82 - protein, 511 aa, Rattus norvegicus
MSGVWGAGGPRCQAALAVLASLCRARPPPLGLDVETCQSFELQPPEQSPSAADSGTSVSLLAVVVIVCGVALVAVFFFLFWKLCWMPWRNKEASSPSSANPASEILQSPSSRGNMADKLKDPSALGFLEAAVKISHTSPDIPAEVQMSVKEHIMRHTKLQRQTTEPASSTRHTSFKRHLPRQMHVSSVDYGNELPPAAAEQPTSIGRIKPELYKQKSVDGDEAKSEAAKSCGKINFSLRYDYESETLIVRILKAFDLPAKDFCGSSDPYVKIYLLPDRKCKLQTRVHRKTLNPTFDENFHFPVPYEELADRKLHLSVFDFDRFSRHDMIGEVILDNLFEASDLSRETSIWKDIQYATSESVDLGEIMFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGISAEGLGRDHWNEMLAYPRKPIAHWHCLAEVKKSFKEGTPRL

SEQ ID NO: 83 - protein, 523 aa, Homo sapiens
MSRQFTCKSGAAAKGGFSGCSAVLSGGSSSSFRAGSKGLSGGFGSRSLYSLGGVRSLNVASGSGKSGGYGFGRGRASGFAGSMFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 84 - protein, 524 aa, Mus musculus
MSRQFTCKSGASNRGFSGCSAVLSGGSSSSYRAGGKGLSGGFGSRSLYSLGGGRSITLNMASGSGKNGGFGFGRNRASGFAGSIFGSVALGPVCPAVCPPGGIHQVTVNESLLAPLNVELDPEIQKVRAQEREQIKALNNKFASFIDKVRFLEQQNQVLQTKWELLQQLDLNNCKNNLEPILEGHISNMRKQLETLSGDRVRLDSELRNVRDVVEDYKKKYEEEINRRTAAENEFVLLKKDVDAAYANKVELQAKVDTMDQDIKFFKCLFEAEMAQIQSHISDMSVILSMDNNRNLDLDSIIDEVRAQYEEIALKSKAEAEALYQTKFQELQLAAGRHGDDLKNTKNEITELTRFIQRLRSEIENAKKQASNLETAIADAEQRGDSALKDARAKLDELEGALHQAKEELARMLREYQELMSLKLALDMEIATYRKLLESEECRMSGEYSSPVSISIISSTSGSGGYGFRPSTVSGGYVANSTSCISGVCSVRGGENRSRGSASDYKDTLTKGSSLSTPSKKGGR

SEQ ID NO: 85 - protein, 441 aa, Homo sapiens
MFGSVALGPVCPTVCPPGGIHQVTVNESLLAPLNVELDPEIQKVRAQEREQIKALNNKFASFIDKVRFLEQQNQVLETKWELLQQLDLNNCKNNLEPILEGYISNLRKQLETLSGDRVRLDSELRNVRDVVEDYKKRYEEEINKRTAAENEFVLLKKDVDAAYANKVELQAKVESMDQEIKFFRCLFEAEITQIQSHISDMSVILSMDNNRNLDLDSIIDEVRTQYEEIALKSKAEAEALYQTKFQELQLAAGRHGDDLKNTKNEISELTRLIQRIRSEIENVKKQASNLETAIADAEQRGDNALKDARAKLDELEGALHQAKEELARMLREYQELMSLKLALDMEIATYRKLLESEECRMSGEFPSPVSISIISSTSGGSVYGFRPSMVSGGYVANSSNCISGVCSVRGGEGRSRGSANDYKDTLGKGSSLSAPSKKTSR

SEQ ID NO: 86 - protein, 534 aa, Homo sapiens
MIARQQCVRGGPRGFSCGSAIVGGGKRGAFSSVSMSGGAGRCSSGGFGSRSLYNLRGNKSISMSVAGSRQGACFGGAGGFGTGGFGAGGFGAGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 87 - protein, 534 aa, Homo sapiens
MIARQQCVRGGPRGFSCGSAIVGGGKRGAFSSVSMSGGAGRCSSGGFGSRSLYNLRGNKSISMSVAGSRQGACFGGAGGFGTGGFGAGGFGAGFGTGGFGGGFGGSFSGKGGPGFPVLPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAKEELARMLREYQELMSVKLALDIEIATYRKLLEGEEYRMSGECQSAVSISVVSGSTSTGGISGGLGSGSGFGLSSGFGSGSGSGFGFGGSVSGSSSSKIIGTTTLNKRR

SEQ ID NO: 88 - protein, 961 aa, Mus musculus
MGAAAVRWHLSLLLALGARGQLVGGSGLPGAVDVDECSEGTDDCHIDAICQNTPKSYKCLCKPGYKGEGRQCEDIDECENDYYNGGCVHDCINIPGNYRCTCFDGFMLAHDGHNCLDVDECQDNNGGCQQICVNAMGSYECQCHSGFFLSDNQHTCIHRSNEGMNCMNKDHGCAHICRETPKGGVACDCRPGFDLAQNQKDCTLTCNYGNGGCQHSCEDTDTGPMCGCHQKYALHADGRTCIETCAVNNGGCDRTCKDTATGVRCSCPVGFTLQPDGKTCKDINECLMNNGGCDHFCRNTVGSFECGCQKGHKLLTDERTCQDIDECSFERTCDHICINSPGSFQCLCRRGYTLYGTTHCGDVDECSMNNGSCEQGCVNTRGSYECVCPPGRRLHWNQKDCVEMNGCLSRSKASAQAQLSCGKVGGVENCFLSCLGHSLFMPDSESSYILSCGVPGLQGKTLPKRNGTSSSTGPGCSDAPTTPIRQKARFKIRDAKCHLQPRSQERAKDTLRHPLLDNCHVTFVTLKCDSSKKRRRGRKSPSKEVSHITAEFEVEMKVDEASGTCEADCMRKRAEQSLQAAIKILRKSTGRNQFYVQVLGTEYEVAQRPAKALEGTGTCGIGQILQDGKCVPCAPGTYFSGDPGQCMPCVSGTYQDMEGQLSCTPCPSSEGLGLAGARNVSECGGQCSPGYFSADGFKPCQACPVGTYQPEPGRTGCFPCGGGLLTKHTGTASFQDCEAKVHCSPGHHYNTTTHRCIRCPVGTYQPEFGQNHCISCPGNTSTDFDGSTNVTHCKNQHCGGELGDYTGYIESPNYPGDYPANAECVWHIAPPPKRRILIVVPEIFLPIEDECGDVLVMRKSASPTSVTTYETCQTYERPIAFTSRSRKLWIQFKSNEANSGKGFQVPYVTYDGKSPPSCHSPLCASQGLAWGLRNELHIPASDRAQTQRQKLGLGNAETQGV

SEQ ID NO: 89 - protein, 999 aa, Homo sapiens
MGVAGRNRPGAAWAVLLLLLLLPPLLLLAGAVPPGRGRAAGPQEDVDECAQGLDDCHADALCQNTPTSYKCSCKPGYQGEGRQCEDIDECGNELNGGCVHDCLNIPGNYRCTCFDGFMLAHDGHNCLDVDECLENNGGCQHTCVNVMGSYECCCKEGFFLSDNQHTCIHRSEEGLSCMNKDHGCSHICKEAPRGSVACECRPGFELAKNQRDCILTCNHGNGGCQHSCDDTADGPECSCHPQYKMHTDGRSCLEREDTVLEVTESNTTSVVDGDKRVKRRLLMETCAVNNGGCDRTCKDTSTGVHCSCPVGFTLQLDGKTCKDIDECQTRNGGCDHFCKNIVGSFDCGCKKGFKLLTDEKSCQDVDECSLDRTCDHSCINHPGTFACACNRGYTLYGFTHCGDTNECSINNGGCQQVCVNTVGSYECQCHPGYKLHWNKKDCVEVKGLLPTSVSPRVSLHCGKSGGGDGCFLRCHSGIHLSSDVTTIRTSVTFKLNEGKCSLKNAELFPEGLRPALPEKHSSVKESFRYVNLTCSSGKQVPGAPGRPSTPKEMFITVEFELETNQKEVTASCDLSCIVKRTEKRLRKAIRTLRKAVHREQFHLQLSGMNLDVAKKPPRTSERQAESCGVGQGHAENQCVSCRAGTYYDGARERCILCPNGTFQNEEGQMTCEPCPRPGNSGALKTPEAWNMSECGGLCQPGEYSADGFAPCQLCALGTFQPEAGRTSCFPCGGGLATKHQGATSFQDCETRVQCSPGHFYNTTTHRCIRCPVGTYQPEFGKNNCVSCPGNTTTDFDGSTNITQCKNRRCGGELGDFTGYIESPNYPGNYPANTECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 90 - protein, 997 aa, Mus musculus
MGVAGCGRPREARALLLLLLLLPPLLAAAVPPDRGLTNGPSEDVDECAQGLDDCHADALCQNTPTSYKCSCKPGYQGEGRQCEDMDECDNTLNGGCVHDCLNIPGNYRCTCFDGFMLAHDGHNCLDMDECLENNGGCQHICTNVIGSYECRCKEGFFLSDNQHTCIHRSEEGLSCMNKDHGCGHICKEAPRGSVACECRPGFELAKNQKDCILTCNHGNGGCQHSCEDTAEGPECSCHPRYRLHADGRSCLEQEGTVLEGTESNATSVADGDKRVKRRLLMETCAVNNGGCDRTCKDTSTGVHCSCPTGFTLQVDGKTCKDIDECQTRNGGCNHFCKNTVGSFDCSCKKGFKLLTDEKSCQDVDECSLERTCDHSCINHPGTFICACNPGYTLYSFTHCGDTNECSVNNGGCQQVCINTVGSYECQCHPGFKLHWNKKDCVEVKGFPPTSMTPRVSLHCGKSGGGDRCFLRCRSGIHLSSDVVTVRTSVTFKLNEGKCSLQKAKLSPEGLRPALPERHSSVKESFQYANLTCSPGKQVPGALGRLNAPKEMFITVEFERETYEKEVTASCNLSCVVKRTEKRLRKALRTLKRAAHREQFHLQLSGMDLDMAKTPSRVSGQHEETCGVGQGHEESQCVSCRAGTYYDGSQERCILCPNGTFQNEEGQVTCEPCPRPENLGSLKISEAWNVSDCGGLCQPGEYSANGFAPCQLCALGTFQPDVGRTSCLSCGGGLPTKHLGATSFQDCETRVQCSPGHFYNTTTHRCIRCPLGTYQPEFGKNNCVSCPGNTTTDFDGSTNITQCKNRKCGGELGDFTGYIESPNYPGNYPANSECTWTINPPPKRRILIVVPEIFLPIEDDCGDYLVMRKTSSSNSVTTYETCQTYERPIAFTSRSKKLWIQFKSNEGNSARGFQVPYVTYDEDYQELIEDIVRDGRLYASENHQEILKDKKLIKALFDVLAHPQNYFKYTAQESREMFPRSFIRLLRSKVSRFLRPYK

SEQ ID NO: 91 - protein, 161 aa, Homo sapiens
MGAAAVRWHLCVLLALGTRGRLAGGSGLPGSVDVDECSEGTDDCHIDAICQNTPKSYKCLCKPGYKGEGKQCEDIDECENDYYNGGCVHECINIPGNYRCTCFDGFMLAHDGHNCLDVDECQDNNGGCQQICVNAMGSYECQCHSGFFLSDNQHTCIHRSN

SEQ ID NO: 92 - protein, 956 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPFSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 93 - protein, 473 aa, Homo sapiens
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQRFMW

SEQ ID NO: 94 - protein, 473 aa, Homo sapiens [sequence omitted]

SEQ ID NO: 95 - protein, 474 aa, Rattus norvegicus
MAQLEGYYFSAALSCTFLVSCLLFSAFSRALREPYMDEIFHLPQAQRYCEGRFSLSQWDPMITTLPGLYLVSVGVVKPASWILGWSEHVVCSIGMLRFVNLLFSVGNFYLLYLLFRKIQPRNKASSSIQRILSTLTLAVFPTLYFFNFLYYTEAGSVFFTLFAYLMCLYGNHRTSALLGFCGFMFRQTNIIWAAFCAGHIIAQKCSEAWKTELQKKKEERLPPAKGPLSELRRVLQFLLMYSMSLKNLSMLFLLTWPYMLLLLAFFVFVVVNGGIVVGDRSSHEACLHFPQLFYFFSFTAFFSFPHLLSPTKVKTFLSLVWKRRVQFSVITLVSVFLVWKFTYVHKYLLADNRHYTFYVWKRVFQRHEIVKYLLVPAYMFAGWAVADSLKSKSIFWNLMFFVCLVASTVPQKLLEFRYFILPYIIYRLNMPLPPISRLVCELGCYAVVNFLTFYIFLNKTFQWSDSHDIQRFMW

SEQ ID NO: 96 - protein, 413 aa, Homo sapiens
MITTLPGLYLVSVGVVKPAIWIFAWSEHVVCSIGMLRFVNLLFSVGNFYLLYLLFHKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLFCLTWPYILLGFLFCAFVVVNGGIVIGDRSSHEACLHFPQLFYFFSFTLFFSFPHLLSPSKIKTFLSLVWKHGILFLVVTLVSVFLVWKFTYAHKYLLADNRHYTFYVWKRVFQRYAILKYLLVPAYIFAGWSIADSLKSKPIFWNLMFFICLFIVIVPQKLLEFRYFILPYVIYRLNITLPPTSRLVCELSCYAIVNFITFYIFLNKTFQWPNSQDIQRFMW

SEQ ID NO: 97 - protein, 317 aa, Homo sapiens
MFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQRFMW

SEQ ID NO: 98 - protein, 727 aa, Mus musculus
MERACEKQDSVCNLVAVFENNRTPGEAPGSHSLEDQPHIPEHQLSLSPEPWEAPPVKEALKSEFRPVSRTYLSSLKNKLSSGAWRRSCQPGVSPGPETQEPEEKRVVRELLETEQAYVARLHLLDQVFFQELLREAGRSKAFPEDVVKLIFSNISSIYRFHAQFFLPELQRRVDDWAATPRIGDVIQKLAPFLKMYSEYVKNFERAAELLATWMDKSQPFQEVVTRIQCSEASSSLTLQHHMLEPVQRIPRYELLLKEYVQKLPAQAPDLEDAQRALDMIFSAAQHSNAAIAEMERLQGLWDVYQRLGLEDDIVDPSNTLLREGPVLKISFRRSDPMERYLVLFNNMLLYCVPRVLQVGAQFQVRTRIDVAGMKVRELTDAEFPHSFLVSGKQRTLELQARSRDEMVSWMQACQAAIDQVEKRSETFKAAVQGPQGDTQEPKPQVEELGLRAPQWVRDKMVTMCMRCQEPFNALTRRRHHCRACGYVVCAKCSDYRAELKYDSNRPNRVCLTCYTFLTGNVLPQGKEDKRRGILEKEASAAPEQSLVCSFLQLIGDKCSRSLPRSWCVIPRDDPLVLYVYAAPQDTKAHTSIPLLGYQVISGPQGTSGFPAATVRRAVHLQGRVCGAAGPLGDSYQACASGTPEDLTKKMCLTEPAASCSSRVHDSLPRPTPWFYHFTPSWATPDPPDVYTETIHPDSVSSRHRPFPSGRYHQVSQLAGEGADIPGS

SEQ ID NO: 99 - protein, 766 aa, Mus musculus
MEESNPAPTSCTSKGKHSKVSDLISHFEGGSVLSSYIDLQKDSTMNLNIPQTLGQPGLTSSPPRKFLPQHSPQKQENDPDQTQGQHGCLANGVVAAQNQMECEDEKETTLSPEMAIQTAAASPDTHVLNGERNETITDSASSIANSHDENASDSSCRTPGTDLGLPSKEGEPGMDAELQERENGVNTMGLDTLDQHHEVKETNEQKLHKIATELLLTERAYVSRLDLLDQVFYCKLLEEANRGSFPAEMVNKIFSNISSINAFHSKFLLPELEKRMQEWETTPRIGDILQKLAPFLKMYGEYVKGFDNAVELVKTMTERVPQFKSVTEEIQKQKICGSLTLQHHMLEPIQRIPRYEMLLKDYLKKLSPDSPDWNDAKKSLEIISTAASHSNSAIRKMENLKKLLEIYEMLGEEEDIVNPSNELIKEGQILKLAARNTSAQERYLFLFNNMLLYCVPRFSLVGSKFTVRTRVGIDGMKIVETHNEEYPHTFQISGKERTLELQASSEQDKEEWIKALQESIDAFHQRHETFRNAIAKENDIPLEVSTAELGKRAPRWIRDNEVTMCMKCKESFNALTRRRHHCRACGHVVCWKCSDYKAQLEYDGGRLNKVCKDCYQIISGFTDSEEKKRRGILEIESAEVSGNSEVCSFLQYMEKSKPWQKIWCVIPKQDPLVLYMYGAPQDVRAQATIPLLGYVVDDMPKSADLPHSFKLTQSKSVHSFAADNEELKQKWLKIILLAVTGETPDGPSEHLATLNNLPGPKKKSEC

SEQ ID NO: 100 - protein, 766 aa, Rattus norvegicus
MEESNPAPTSCASKGKHSKVSDLISHFEGGSVLSSYTDVQKDSTMNLNIPQTPRQHGLTSTTPQKLPSHKSPQKQEKDSDQNQGQHGCLANGVAAAQSQMECETEKEAALSPETDTQTAAASPDAHVLNGVRNETTTDSASSVTNSHDENACDSSCRTQGTDLGLPSKEGEPVIEAELQERENGLSTEGLNPLDQHHEVKETNEQKLHKIATELLLTERAYVSRLNLLDQVFYCKLLEEANRGSFPAEMVNKIFSNISSINAFHSKFLLPELEKRMQEWETTPRIGDILQKLAPFLKMYGEYVKGFDNAVELVKNMTERVPQFKSVTEEIQKQKICGSLTLQHHMLEPIQRIPRYEMLLKDYLKKLSPDAPDWNDAKKSLEIISTAASHSNSAIRKMENLKKLLEIYEMLGEEEDIVNPSNELIKEGQILKLAARNTSAQERYLFLFNNMLLYCVPRFSLVGSKFTVRTRVGIDGMKIVETHNEEYPHTFQVSGKERTLELQASSEQDKEEWIKALQESIDAFHQRHETFRNAIAKENDIPLEVSTAELGKRAPRWIRDNEVTMCMKCKESFNALTRRRHHCRACGHVVCWKCSDYKAQLEYDGGRLNKVCKDCYQIMSGFAESEEKKRRGILEIESAEVSGNSEVCSFLQYMEKSKPWQKIWCVIPKQDPLVLYMYGAPQDVRAQATIPLLGYIVDDMPKSADLPHSFKLTQSKSVHSFAADSEELKQKWLKIILLAVTGETPDGPSEHLDTLDNLPGPKEKSEC

SEQ ID NO: 101 - protein, 766 aa, Homo sapiens
MEEIKPASASCVSKEKPSKVSDLISRFEGGSSLSNYSDLKKESAVNLNAPRTPGRHGLTTTPQQKLLSQHLPQRQGNDADKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 102 - protein, 961 aa, Homo sapiens
MHGHRAPGGRRAFGARTPGHEPAGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVGKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPVPLMERQESVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQDVKAQRSLPLIGFEVGPPEAGERPDRRHVFKITQSHLSWYFSPETEELQRRWMAVLGRAGRGDTFCPGPTLSEDREMEEAPVAALGATAEPPESPQTRDKT

SEQ ID NO: 103 - protein, 309 aa, Homo sapiens
MEALALVGAWYTARKSITVICDFYSLIRLHFIPRLGSRADLIKQYGRWAVVSGATDGIGKAYAEELASRGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 104 - protein, 312 aa, Homo sapiens
MLPAAGLLWWVGALGALYAAVRGALGLLGALRVWGIGAGRAALGPGLGAWAVVTGATDGIGKAYAKELAKRGMKVALISRSKEKLDQVAGEITEQYGVETKVIVADFGEREDIYDRIRAGLEGLEIGVLVNNVGISYSYPEYFIDVPDLDKTIDKMININIMSVCKMTRLVLPGMLERSKGVILNISSAAGMYPTPLLTLYSASKAFVDYFSRGLHAEYKSKGIIVQSVMPYYVATKMSKISKPSFDKPTPETYVRAAIGTVGLQSQTNGCLPHAFMGWVFSILPTSTVMNLLMKTNKQIRARFLKKKMKEK

SEQ ID NO: 105 - protein, 312 aa, Homo sapiens
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 106 - protein, 272 aa, Homo sapiens
  VARIANT (3): wherein Xaa is any amino acid
MRXGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 107 - protein, 339 aa, Drosophila melanogaster
MQPVLEVSIYTLLKMAFIWQLISAAIYLVGLLTIGVFLYDNLKSLVSIIKAVLEPYFQPHLPRTLVDKFGQWAVVTGATDGIGKEYARELARQGINLVLISRTKEKLIAVTNEIESQYKVKTKWIAADFAKGREVYDQIEKELAGIDVGILVNNVGMMYEHPESLDLVSEDLLWNLLTVNMGSVTMLTRKILPQMIGRRKGAIVNLGSSSELQPLPNMTVYAASKKFVTYFSKALELEVAEHNIHVQLVMPNFVVTKMNAYTDRVMQGGLFFPNAYTFARSAVFTLGKTSETNGFWTHGIQYAIMKLAPLPIRTYLGHQLFKRLRIEALEQKQKKLKLT

SEQ ID NO: 108 - protein, 755 aa, Rattus norvegicus
MCKDSACFSTMKETDLEAVATAVQRVAGMLQRPDQLDKVEQYRRREARKKASVEARLKAAIQSQLDGVRTGLSQLHNALNDVKDIQQSLADVSKDWRQSINTIESLKDVKDAVVQHSQLAAAVENLKNIFSVPEIVRETQDLIEQGALLQAHRKLMDLECSRDGLMCEQYRMDSGNKRDMTLIHGYFGSTQGLSDELAKQLWMVLQRSLVTVRRDPTLLVSVVRIIEREEKIDRRILDRKKQTGFVPPGRPKNWKEKMFAVLDRTVTTRIEGTQADTRESDKMWLVRHLEIIRKYVLDDLVIAKNLLVQCFPPHYDIFKNLLSMYHQALSIRMQDLASEDLEANEIVSLLTWVLNTYTSAEMMGNVELAPEVDVNALEPLLSPNVVSELLDTYMSTLTSNIIAWLRKALETDKKDWSKETEPEADQDGYYQTTLPAIVFQMFEQNLQVAAQISEDLKTKVLVLCLQQMNSFLSRYKEEAQLYKEEHLRNRQHPHCYVQYMVAIINNCQTFKESIISLKRKYLKPETEESLCQSQPSMDGILDAIAKEGCSSLLEEVFLDLEQHLNELMTKKWMLGSNAVDIICVTVEDYFNDFAKIKKPYKKRMTAEAHRRVVVEYLRAVMQKRISFRSAEERKEGAEKMVREAEQLRFLFRKLASGFGEDADGHCDTIVAVAEVIKLTDPSLLYLEVSTLVSKYPDIRDDHIGALLALRGDASRDMKQTIMETLEQGPMQASPNYVPIFQEIVVPSLNVAKLLK

SEQ ID NO: 109 - protein, 471 aa, Homo sapiens
LVRHLEIIRKYVLDDLIVAKNLMVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 110 - protein, 449 aa, Homo sapiens
MVQCFPPHYEIFKNLLNMYHQALSTRMQDLASEDLEANEIVSLLTWVLNTYTSTEMMRNVELAPEVDVGTLEPLLSPHVVSELLDTYMSTLTSNIIAWLRKALETDKKDWVKETEPEADQDGYYQTTLPAIVFQMFEQNLQVAAQISEDLKTKVLVLCLQQMNSFLSRYKDEAQLYKEEHLRNRQHPHCYVQYMIAIINNCQTFKESIVSLKRKYLKNEVEEGVSPSQPSMDGILDAIAKEGCSGLLEEVFLDLEQHLNELMTKKWLLGSNAVDIICVTVEDYFNDFAKIKKPYKKRMTAEAHRRVVVEYLRAVMQKRISFRSPEERKEGAEKMVREAEQLRFLFRKLASGFGEDVDGYCDTIVAVAEVIKLTDPSLLYLEVSTLVSKYPDIRDDHIGALLAVRGDASRDMKQTIMETLEQGPAQASPSYVPLFKDIVVPSLNVAKLLK

SEQ ID NO: 111 - protein, 738 aa, Drosophila melanogaster
MDLQQLEEQARQAALKDIQNMLQRPGQLEKVEQYRHRIARKKASVEALLKTGMQGQLDGVRVGLKQLETCMQDVREVRRRMDEVERLLRGVPEVYDALEVVREENTKHSQYATAMENLKHIFNVDASVQKTMALIEDDKLLNAHQCLADLENSRDDLLYELHKQPKQHASDKITLKRHFEKVDTVSQELEKKLRLILSRTLNTLRKKPTIIVTALRIIEREEKNDQFALQQQKVTGFLPPGRPKAWRRMIMDVLQQSVITRIEGSKLEERADNKMWLVRDLEILRQIILEDLRVVKSLCVPCFPPHYDIFGEYVKFYHEGLSSYLDNIVRSGLEGNEYVSMMAWVTHTYPGVELMSHPDLNVDVHRQIGTLLRPEHLKALEDEYLQNMQRNFQEWMTKAAETEKQEWFTETVPDQDEEYYHTSAPVIIFQMIDQHLQVTNTIHQELTFKALVMSIQQVEIFGQTYLKNVIELKEHHFRNRDQIKYFTHYIITIVNNSQQMVELAQQMKQLYWPKSRTEHYEDFERLLATFQRIRAHAASYLLEEAFLDMECHFNDLFTAKWLASNIAVDTICVTLDDYFQDYNHLRPNNFEMVINEAQKLLAKRYIRALLSKRLSKPRAECDAITRKIKTEAKRFKLFFEKIAPKISLSDSPLDLISTLSALLSSDIELLVLDLHTLLGSYPSLNEDHLVRLFYIRNDVKAAEVREKVQDAMKSKKAMVSIAKQDCIFKEIVFSDKLW

SEQ ID NO: 112 - protein, 681 aa, Drosophila melanogaster
MDLQQLEEQARQAALKDIQNMLQRPGQLEKVEQYRHRIARKKASVEALLKTGMQGQLDGVRVGLKQLETCMQDVREYATAMENLKHIFNVDASVQKTMALIEDDKLLNAHQCLADLENSRDDLLYELHKQPKQHASDKITLKRHFEKVDTVSQELEKKLRLILSRTLNTLRKKPTIIVTALRIIEREEKNDQFALQQQKSVITRIEGSKLEERADNKMWLVRDLEILRQIILEDLRVVKSLCVPCFPPHYDIFGEYVKFYHEGLSSYLDNIVRSGLEGNEYVSMMAWVTHTYPGVELMSHPDLNVDVHRQIGTLLRPEHLKALEDEYLQNMQRNFQEWMTKAAETEKQEWFTETVPDQDEEYYHTSAPVIIFQMIDQHLQVTNTIHQELTFKALVMSIQQVEIFGQTYLKNVIELKEHHFRNRDQIKYFTHYIITIVNNSQQMVELAQQMKQLYWPKSRTEHYEDFERLLATFQRIRAHAASYLLEEAFLDMECHFNDLFTAKWLASNIAVDTICVTLDDYFQDYNHLRPNNFEMVINEAQKLLAKRYIRALLSKRLSKPRAECDAITRKIKTEAKRFKLFFEKIAPKISLSDSPLDLISTLSALLSSDIELLVLDLHTLLGSYPSLNEDHLVRLFYIRNDVKAAEVREKVQDAMKSKKAMVSIAKQDCIFKEIVFSDKLW

SEQ ID NO: 113 - protein, 523 aa, Homo sapiens; identical to SEQ ID NO: 83

SEQ ID NO: 114 - protein, 524 aa, Mus musculus; identical to SEQ ID NO: 84

SEQ ID NO: 115 - protein, 441 aa, Homo sapiens; identical to SEQ ID NO: 85

SEQ ID NO: 116 - protein, 551 aa, Homo sapiens [sequence omitted]

SEQ ID NO: 117 - protein, 551 aa, Homo sapiens
MSRQSSITFQSGSRRGFSTTSAITPAAGRSRFSSVSVARSAAGSGGLGRISSAGASFGSRSLYNLGGAKRVSINGCGSSCRSGFGGRASNGFGVNSGFGYGGGVGGGFSGPSFPVCPPGGIQEVTVNQSLLTPLHLQIDPTIQRVRAEEREQIKTLNNKFASFIDKVRFLEQQNKVLETKWALLQEQGSRTVRQNLEPLFDSYTSELRRQLESITTERGRLEAELRNMQDVVEDFKVRYEDEINKRTAAENEFVALKKDVDAAYMNKVELEAKVKSLPEEINFSHSVFDAELSQLQTQVGDTSVVLSMDNNRNLDLDSIIAEVKAQYEDIANRSRAEAESWYQTKYEELQVTAGRHGDDLRNTKQEISEMNRMIQRLRAEIDSVKKQCSSLQTAIADAEQRGELALKDARAKLVDLEEALQKAKQDMARLLREYQELMNIKLALDVEIATYRKLLEGEECRLSGEGVSPVNISVVTSTLSSGYGRGSSIGGGNLGLGGGSGYSFTTSGGHSLGAGLGGSGFSATSNRGLGGSGSSVKFVSTTSSSQKSYTH

SEQ ID NO: 118 - protein, 786 aa, Homo sapiens [sequence omitted]

SEQ ID NO: 119 - protein, 776 aa, Rattus norvegicus
MVIMSEFSAVPTGTGQGQQKPLRVGFYDVERTLGKGNFAVVKLARHRVTKTQVAIKIIDKTRLDSSNLEKIYREVQLMKLLNHPNIIKLYQVMETKDMLYIVTEFAKNGEMFDYLTSNGHLSENEARKKFWQILSAVEYCHNHHIVHRDLKTENLLLDGNMDIKLADFGFGNFYKPGEPLSTWCGSPPYAAPEVFEGKEYEGPQLDIWSLGVVLYVLVCGSLPFDGPNLPTLRQRVLEGRFRIPFFMSQDCETLIRRMLVVDPAKRITIAQIRQHRWMQADPTLLQQDDPAFSMQGYTSNLGDYNEQVLGIMQALGIDRQRTVESLQNSSYNHFAAIYYLLLERLREHRSTQPSSRATPAPARQPQLRNSDLSSLEVPQEILPCDPFRPSLLCPQPQALAQSVLQAEIDCDLHSSLQPLFFPLDTNCSGVFRHRSISPSSLLDTAISEEARQGPSLEEEQEVQEPLPGSTGRKHTLAEVSTHFSPLNPPCIIVSSSAAVSPSEGTSSDSCLPFSASEGPAGLGGGLATPGLLGTSSPVRLASPFLGSQSATPVLQSQAGLGATVLPPVSFQEGRRASDTSLTQGLKAFRQQLRKNARTKGFLGLNKIKGLARQVCQSSIRGSRGGMSTFHTPAPSSGLQGCTASSREGRSLLEEVLHQQRLLQLQHHSAVSSDYQQAPQLSPVPYVLTPCDGLLVSGIPLLPTPLLQPGMSPVASAAQLLDAHLHISAGPVALPTGPLPQCLTRLSPSCDPAGLPQGDCEMEDLTSGQRGTFVLVQ

SEQ ID NO: 120 - protein, 776 aa, Rattus norvegicus
MVIMSEFSAVPTGTGQGQQKPLRVGFYDVERTLGKGNFAVVKLARHRVTKTQVAIKIIDKTRLDSSNLEKIYREVQLMKLLNHPNIIKLYQVMETKDMLYIVTEFAKNGEMFDYLTSNGHLSENEARKKFWQILSAVEYCHNHHIVHRDLKTENLLLDGNMDIKLADFGFGNFYKPGEPLSTWCGSPPYAAPEVFEGKEYEGPQLDIWSLGVVLYVLVCGSLPFDGPNLPTLRQRVLEGRFRIPFFMSQDCETLIRRMLVVDPAKRITIAQIRQHRWMQADPTLLQQDDPAFSMQGYTSNLGDYNEQVLGIMQALGIDRQRTVESLQNSSYNHFAAIYYLLLERLREHRSTQPSSRATPAPARQPQLRNSDLSSLEVPQEILPCDPFRPSLLCPQPQALAQSVLQAEIDCDLHSSLQPLFFPLDTNCSGVFRHRSISPSSLLDTAISEEARQGPSLEEEQEVQEPLPGSTGRRHTLAEVSTHFSPLNPPCIIVSSSAAVSPSEGTSSDSCLPFSASEGPAGLGGGLATPGLLGTSSPVRLASPFLGSQSATPVLQSQAGLGATVLPPVSFQEGRRASDTSLTQGLKAFRQQLRKNARTKGFLGLNKIKGLARQVCQSSIRGSRGGMSTFHTPAPSSGLQGCTASSREGRSLLEEVLHQQRLLQLQHHSAVSSDYQQAPQLSPVPYVLTPCDGLLVSGIPLLPTPLLQPGMSPVASAAQLLDAHLHISAGPVALPTGPLPQCLTRLSPSCDPAGLPQGDCEMEDLTSGQRGTFVLVQ

SEQ ID NO: 121 - protein, 779 aa, Mus musculus
MVIMSEFSAVPSGTGQGQQKPLRVGFYDVERTLGKGNFAVVKLARHRVTKTQVAIKIIDKTRLDSSNLEKIYREVQLMKLLNHPNIIKLYQVMETKDMLYIVTEFAKNGEMFDYLTSNGHLSENEARQKFWQILSAVEYCHNHHIVHRDLKTENLLLDSNMDIKLADFGFGNFYKPGEPLSTCVGSPPYAAPEVFEGKEYEGPQLDVWSLGVVLYVLVCGSLPFDGPNLPTLRQRVLEGRFRIPFFMSQDCETLIRRMLVVDPAKRITIAQIRQHRWMQADPTLLQQDDPAFDMQGYTSNLGDYNEQVLGIMQALGIDRQRTIESLQNSSYNHFAAIYYLLLERLKEHRSAQPSSRPTPAPTRQPQLRSSDLSSLEVPQEILPCDPFRPSLLCPQPQALAQSVLQAEIDCDLHSSLQPLLFPLDTNCSGVFRHRSISPSSLLDTAISEEARQGPSLEEEQEVQEPLPGSTGRRHTLAEVSTHFSPLNPPCIIVSSSATASPSEGTSSDSCLPFSASEGPAGLGSGLATPGLLGTSSPVRLASPFLGSQSATPVLQTQAGLGTAVLPPVSFQEGRRASDTSLTQGLKAFRQQLRKNARTKGFLGLNKIKGLARQVCQSSVRTPRGGMSTFHTPAPSSGLQGCTTSNREGRSLLEEVLHQQRLLQLQHHSSTAAASSGCQQGPQLSPVPYVLAPCDSLLVSGIPLLPTPLLQAGMSPVASAAHLLDTHLHISAGPVALPTGPLPQCLTRLSPGCDPAGLPQGDCEMEDLTSGQRGTFVLVQ

SEQ ID NO: 122 - protein, 798 aa, Gallus gallus
MVIMSEDASVPAPSAAQPRPLRVGFYDIERTLGKGNFAVVKLARHRVTKTQVAIKIIDKTRLDPSNLEKIYREVQIMKLLNHPHIIKLYQVMETKDMLYIVTEFAKNGEMFDHLTSNGHLSESEARKKFWQILSAVEYCHSHHIVHRDLKTENLLLDANMNIKLADFGFGNFYKSGEPLSTWCGSPPYAAPEVFEGKEYEGPHLDIWSLGVVLYVLVCGSLPFDGPNLPTLRQRVLEGRFRIPYFMSEDCETLIRRMLVVDPTKRITISQIKQHKWMQADPSLRQQQSLSFSMQNYNSNLGDYNEQVLGIMQTLGIDRQRTVESLQNSSYNHFAAIYYLLLERLKEYRSSQLSSRPATGRQQRPRSSEISNAEMPQDSLTSETLRSSLLYQQPQSLIQPSLQAEMDCDMNNPLQPVFFPVDPNFNGLFRNRSISPSSLLETTISEEVRQEKELEDEIKAYDHPIRIPSNTSRRHTLAEVTTHFYQHAPPCIVISSSASPTEGTSSDSCLTSSSNDSSVALSSCLAGQVMTGSPATARMTSAFLASQSDAPVLQVQGCMGGASLLPVSFQEGRRASDTSLTQGLKAFRQQLRKNARAKGFLGLNKIKGFARQVCQSSSSRAARSAMSPFQHAQPNTCIYSSSGSSREGRNLLEEVLQQQRMLQLQHHQLLQPACPQTSQTSATNGLPPSDSAGTCKASNSLLLSELQRENSFELAFGGNSQLLQPHFFGVSVSPVSSAAHLLDTHLYISSNVSPVGTTFSQQQSFSAQSPSYDAVTLQHGDCEMEDLTSNQLGKFVLVK

SEQ ID NO: 123 - protein, 484 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKAVKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 124 - protein, 484 aa, Homo sapiens
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 125 - protein, 455 aa, Rattus norvegicus
MRKIPNHGTLRMTKVAYPLGLCVGLFIYVAYIKWHRASAAQAFFTIAGAASGVRWTQQAFSSPDSATRGHEVFYGIMFDAGSTGTRIHVFQFARPPGETPTLTHETFKALKPGLSAYADDVEKSAQGIQELLNVAKQHIPYDFWKATPLVLKATAGLRLLPGEKAQKLLQKVKEVFKASPFLVGDDCVSIMNGTDEGVSAWITVNFLTGSLKTPGSSSVGMLDLGGGSTQITFLPRVEGTLQASPPGHLTALQMFNRTFKLYSYSYLGLGLMSARLAILGGVEGKPAEDDKELVSPCLSPRFRGKWEHAEVTYRISGQKAVGLYELCASRVSEVLRNKVHRTEEAQHVDFYAFSYYYDLAASFGLIDAEKGGSLVVGDFEIAAKYVCRTLETQPPSSPFACMDLTYISLLLHEFGFPGDKVLKLARKIDNVETSWALGAIFHYIDSLKRQKVPAL

SEQ ID NO: 126 - protein, 427 aa, Mus musculus
MATSWGAVFMLIIACVGSTVFYREQQTWFEGVFLSSMCPINVSAGTFYGIMFDAGSTGTRIHVYTFVQKTAGQLPFLEGEIFDSVKPGLSAFVDQPKQGAETVQELLEVAKDSIPRSHWERTPVVLKATAGLRLLPEQKAQALLLEVEEIFKNSPFLVPDGSVSIMDGSYEGILAWVTVNFLTGQLHGRGQETVGTLDLGGASTQITFLPQFEKTLEQTPRGYLTSFEMFNSTFKLYTHSYLGFGLKAARLATLGALEAKGTDGHTFRSACLPRWLEAEWIFGGVKYQYGGNQEGEMGFEPCYAEVLRVVQGKLHQPEEVRGSAFYAFSYYYDRAADTHLIDYEKGGVLKVEDFERKAREVCDNLGSFSSGSPFLCMDLTYITALLKDGFGFADGTLLQLTKKVNNIETGWALGATFHLLQSLGITS

SEQ ID NO: 127 - protein, 428 aa, Homo sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 128 - protein, 504 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 129 - protein, 564 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPASTVGMDRVNVSRVYTAGSHIYTPAVVFRSLSHGPHAHLTHAAKMHNRTPIHNYKGHKATAGLAFHRHKYSPSAITST

SEQ ID NO: 130 - protein, 501 aa, Mus musculus
MEAASTWALLLALLLLLLLLSLTLFRTPARGYLPPGPTPLPLLGNLLQLRPGALYSGLLRLSKKYGPVFTVYLGPWRRVVVLVGHDAVREALGGQAEEFSGRGTLATLDKTFDGHGVFFANGERWKQLRKFTLLALRDLGMGKREGEELIQAEVQSLVEAFQKTEGRPFNPSMLLAQATSNVVCSLVFGIRLPYDDKEFQAVIQAASGTLLGISSPWGQAYEMFSWLLQPLPGPHTQLQHHLGTLAAFTIQQVQKHQGRFQTSGPARDVVDAFLLKMAQEKQDPGTEFTEKNLLMTVTYLLFAGTMTIGATIRYALLLLLRYPQVQQRVREELIQELGPGRAPSLSDRVRLPYTDAVLHEAQRLLALVPMGMPHTITRTTCFRGYTLPKGTEVFPLIGSILHDPAVFQNPGEFHPGRFLDEDGRLRKHEAFLPYSLGKRVCLGEGLARAELWLFFTSILQAFSLETPCPPGDLSLKPAISGLFNIPPDFQLRVWPTGDQSR

SEQ ID NO: 131 - protein, 494 aa, RABBIT
MELGGAFTIFLALCFSCLLILIAWKRVQKPGRLPPGPTPIPFLGNLLQVRTDATFQSFLKLREKYGPVFTVYMGPRPVVILCGHEAVKEALVDRADEFSGRGELASVERNFQGHGVALANGERWRILRRFSLTILRDFGMGKRSIEERIQEEAGYLLEEFRKTKGAPIDPTFFLSRTVSNVISSVVFGSRFDYEDKQFLSLLRMINESFIEMSTPWAQLYDMYSGVMQYLPGRHNRIYYLIEELKDFIAARVKVNEASLDPQNPRDFIDCFLIKMHQDKNNPHTEFNLKNLVLTTLNLFFAGTETVSSTLRYGFLLIMKHPEVQTKIYEEINQVIGPHRIPSVDDRVKMPFTDAVIHEIQRLTDIVPMGVPHNVIRDTHFRGYLLPKGTDVFPLLGSVLKDPKYFCHPDDFYPQHFLDEQGRFKKNEAFVPFSSGKRICLGEAMARMELFLYFTSILQNFSLHPLVPPVNIDITPKISGFGNIPPTYELCLIAR

SEQ ID NO: 132 - protein, 494 aa, Mesocricetus auratus
MLASGLLLVTVLAFLVVLILMSVWKQRKLSGKLPPGPTPLPFIGNYLQLNTEQMYNSLMKISERYGPVFTIHLGPRPIVVLCGQEAVKEALVDQAEEFSGRGEQATFDWLFKGYGVAFSSGERAKQLRRFSIATLRDFGVGKRGIEERIQEEAGFLLEAFRKTNGALIDPTFYLSRTVSNVISSIVFGDRFDYEDKEFLSLLRMMLGSFQFTGTSTGQLYEMFSSVMKHLPGPQQQAFKELQGLEDFITKKVEQNQRTLDPNSPRDFIDSFLIRMKEEKKNPNTEFYMKNLVLTTLNLFFAGTETVSTTLRYGFLLLMKHPDVEAKVQEEIDRVIGKNRQPKYEDRLKMPYTEAVIHEIQRFGDMIPMGLARRVTKDTKFRGFFIPKGTEVFPMLGSVLRDPKFFSNPKDFNPQHFLDDKGQFKKNDAFVPFSIGKRYCFGEGLARMELFLFLTNILQNFHLRSPQAPQDIDVSPRLVGFATIPPNYTMSFLSR

SEQ ID NO: 133 - protein, 222 aa, Homo sapiens
MNKSESDQEDNDDINDNDWSYGSEKKAKKRKSDKNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 134 - protein, 187 aa, Homo sapiens
PNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 135 - protein, 129 aa, Homo sapiens
MCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 136 - protein, 223 aa, Drosophila melanogaster
MSAANMPTTTGAQGSGNQVPTTSTTIVNHFRELIKEPKNLDEAANYLYQSLLDDAVVGIFNETHHLRKSGNLAALDGVPEDSTYRMCEMPNLDIFGISTAKKPMDCTCPNCDRLVAAARFAPHLEKCMGMGRISSRIASRRLATKEGATSAHLHSSGNTGGTDDEDDVDWSSDKRRKKSNQNSRNNGSKKNNGKTFYDHPYWRTPPIPPSSLDNGNSNGIVIN

SEQ ID NO: 137 - protein, 517 aa, Arabidopsis thaliana
MATTSTTTKLSVLCCSFISSPLVDSPPSLAFFSPIPRFLTVRIATSFRSSSRFPATKIRKSSLAAVMFPENSVLSDVCAFGVTSIVAFSCLGFWGEIGKRGIFDQKLIRKLVHINIGLVFMLCWPLFSSGIQGALFASLVPGLNIVRMLLLGLGVYHDEGTIKSMSRHGDRRELLKGPLYYVLSITSACIYYWKSSPIAIAVICNLCAGDGMADIVGRRFGTEKLPYNKNKSFAGSIGMATAGFLASVAYMYYFASFGYIEDSGGMILRFLVGLVTVTAFQTRKQHEEQEEDGEADDKNYRQDLTMHGVVSVSSEIMIGGFFADVKFNRSREKKLSLPPPFTVATRLYSLSSQIFLDLVDSVIADVASECHRVARLGLDRDLDIVEEELRLSVEARAKIADPSNNLETNTKYVVDIFGQTHPPVASEVFNCMNCGRQIVAGRFAPHLEKCMGKGRKARAKTTRSTTAAQNRNARRSPNPRYSPYPNSASENQLASGSPGVAGEDCSNFTVRENVKGD

SEQ ID NO: 138 - protein, 729 aa, Homo sapiens
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLARRASVSARATGTAFRRSPCNLIYFGEHPLSFAACVNSEEIVRLLIEHGADIRAQDSLGNTVLHILILQPNKTFACQMYNLLLTYDRHGDHLQPLDLWPNHQGLTPFKLAGVEGNTVMFQHLMQKRKHVQWTCGPLTSTLYDLTEIDSWGEELSFLELVVSSDKREARQILEQTPVKEPVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRLCWLMAVVILGFASAFYIIFQTEDPTSLGQFYDYPMALFSTFELFLTIIDGPANYNVDLPFMYSITYAAFAIIATLLMLNLFIAMMGDTHWRVAHERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 139 - protein, 723 aa, Rattus norvegicus
MGVKKPWIQLQKRLNWWVREQDWNQHVDQLHMLQQKSIWESPLLRAAKENDMCTLKRLQHDQNCDFRQRGALGETALHVAALYDNLDAAIMLMETAPYLVTESTLCEPFVGQTALHIAIMNQNVNLVRALLARGASASARATGSAFHRSSHNLIYYGEHPLSFAACVGSEEIVRLLIEHGADIRAQDSLGNTVLHILVLQPNKTFACQMYNLLLSHDGGDHLKSLELVPNNQGLTPFKLAGVEGNTVMFQHLMQKRKHIQWSLGPLTSSIYDLTEIDSWGEDLSFLELVLSSKKIEARQILEQTPVKELVSLKWKKYGQPYFCLLGMLYISYMICFTTCCVYRPLKFRDANRTHVRDNTVLEQKPLQEAYVTYQDKVRLVGELVTVIGAVVILLIEIPDIFRVGASRYFGHTVLGGPFHVIIITYASLVLLIMVMRLTSMNGEVVPISMALVLGWCSVMYFSRGFQMLGPFTIMIQKMIFGDLLRFCRLMAMVILGFASAFYIIFQTEDPESLGEFSDYPTAMFSTFELFLTIIDGPANYSVDLPFMYHLTYFAFAIIATLLMLNLFIAMMGDTHWRVAQERDELWRAQVVATTVMLERKMPRFLWPRSGICGCEYGLGDRWFLRVEHHQEQNPYRVLRYVEAFKSSDKEEVQEQLSEKQPSGTETGTLARGSVVLQTPPLSRTTSLSSNSHRGWEILRRNTLGHLNLGQDLGEGDGEEIYHF

SEQ ID NO: 140 - protein, 723 aa, Rattus norvegicus
MGVKKPWIQLQKRLNWWVREQDWNQHVDQLHMLQQKSIWESPLLRAAKENDMCTLKRLQHDQNCDFRQRGALGETALHVAALYDNLDAAIMLMETAPYLVTESTLCEPFVGQTALHIAIMNQNVNLVRALLARGASASARATGSAFHRSSHNLIYYGEHPLSFAACVGSEEIVRLLIEHGADIRAQDSLGNTVLHILVLQPNKTFACQMYNLLLSHDGGDHLKSLELVPNNQGLTPFKLAGVEGNTVMFQHLMQKRKHIQWSLGPLTSSIYDLTEIDSWGEDLSFLELVVSSKKKEARQILEQTPVKELVSLKWKKYGQPYFCLLGMLYIFYMICFTTCCVYRPLKFRDANRTHVRDNTVLEQKPLQEAYVTYQDKVRLVGELVTVIGAVVILLIEIPDIFRVGASRYFGHTVLGGPFHVIIITYASLVLLIMVMRLTSMNGEVVPISMALVLGWCSVMYFSRGFQMLGPFTIMIQKMIFGDLLRFCWLMAMVILGFASAFYIIFQTEDPESLGEFSDYPTAMFSTFELFLTIIDGPANYSVDLPFMYHLTYFAFAIIATLLMLNLFIAMMGDTHWRVAQERDELWRAQVVATTVMLERKMPRFLWPRSGICGCEYGLGDRWFLRVEHHQEQNPYRVLRYVEAFKSSDKEEVQEQLSEKQPSGTETGTLARGSVVLQTPPLSRTTSLSSNSHRGWEILRRNTLGHLNLGQDLGEGDGEEIYHF

SEQ ID NO: 141 - protein, 730 aa, Oryctolagus cuniculus
MGACPPKAKGPWAQLQKLLISWPVGEQDWEQYRDRVNMLQQERIRDSPLLQAAKENDLRLLKILLLNQSCDFQQRGAVGETALHVAALYDNLEAATLLMEAAPELAKEPALCEPFVGQTALHIAVMNQNLNLVRALLARGASVSARATGAAFRRSPHNLIYYGEHPLSFAACVGSEEIVRLLIEHGADIRAQDSLGNTVLHILILQPNKTFACQMYNLLLSYDEHSDHLQSLELVPNHQGLTPFKLAGVEGNTVMFQHLMQKRKHVQWTCGPLTSTLYDLTEIDSWGEELSFLELVVSSKKREARQILEQTPVKELVSFKWKKYGRPYFCVLASLYILYMICFTTCCIYRPLKLRDDNRTDPRDITILQQKLLQEAYVTHQDNIRLVGELVTVTGAVIILLLEIPDIFRVGASRYFGQTILGGPFHVIIITYASLVLLTMVMRLTNMNGEVVPLSFALVLGWCSVMYFARGFQMLGPFTIMIQKMIFGDLMRFCWLMAVVILGFASAFHITFQTEDPNNLGEFSDYPTALFSTFELFLTIIDGPANYSVDLPFMYCITYAAFAIIATLLMLNLFIAMMGDTHWRVAQERDELWRAQVVATTVMLERKMPRFLWPRSGICGYEYGLGDRWFLRVENHHDQNPLRVLRYVEAFKCSDKEDGQEQLSEKRPSTVESGMLSRASVAFQTPSLSRTTSQSSNSHRGWEILRRNTLGHLNLGLDLGEGDGEEVYHF

SEQ ID NO: 142 - protein, 729 aa, Homo sapiens
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRRSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFAIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 143 - protein, 290 aa, Homo sapiens
MADLSFIEDTVAFPEKEEDEEEEEKGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 144 - protein, 290 aa, Homo sapiens
MADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 145 - protein, 289 aa, Homo sapiens
ADLSFIEDTVAFPEKEEDEEEEEEGVEWGYEEGVEWGLVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAAFQ

SEQ ID NO: 146 - protein, 291 aa, Mus musculus
MADLSFIEDAVAFPEKEEDEEEEEEEGVEWGYEEGVEWGLVFPDANGEYQSPINLNSREARYDPSLLDVRLSPNYVVCRDCEVTNDGHTIQVILKSKSVLSGGPLPQGQEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQMQIEEFRRLRTHVKGAELVEGCDGILGDNFRPTQPLSDRVIRAAFQ

SEQ ID NO: 147 - protein, 291 aa, Mus musculus
MADLSFIEDAVAFPEKEEDEEEEEEEGVEWGYEEGVEWGLVFPDANGEYQSPINLNSREARYDPSLLDVRLSPNYVVCRDCEVTNDGHTIQVILKSKSVLSGGPLPQGQEFELYEVRFHWGRENQRGSEHTVNFKAFPMELHLIHWNSTLFGSIDEAVGKPHGIAIIALFVQIGKEHVGLKAVTEILQDIQYKGKSKTIPCFNPNTLLPDPLLRDYWVYEGSLTIPPCSEGVTWILFRYPLTISQMQIEEFRRLRTHVKGVELVEGCDGILGDNFRPTQPLSDRVIRAAFQ

SEQ ID NO: 148 - protein, 117 aa, Homo sapiens; identical to SEQ ID NO: 50

SEQ ID NO: 149 - protein, 117 aa, Mus musculus
MKFQYKEDHPFEYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSDESVYGK

SEQ ID NO: 150 - protein, 117 aa, Homo sapiens
MKFVYKEEHPFEKRRSEGEKIRKKYPDRVPVIVEKAPKARIGDLDKKKYLVPSDLTVGQFYFLIRKRIHLRAEDALFFFVNNVIPPTSATMGQLYQEHHEEDFFLYIAYSDESVYGL

SEQ ID NO: 151 - protein, 117 aa, Mus musculus
MKFVYKEEHPFDKRRSEGEKIRKKYPDRVPVIVEKAPKARIGDLDKKKYLVPSDLTVGQFYFLIRKRIHLRAEDALFFFVNNVIPPTSATMGQLYQEHHEEDFFLYIAYSDESVYGL

SEQ ID NO: 152 - protein, 121 aa, Drosophila melanogaster
MKFQYKEEHAFEKRRAEGDKIRRKYPDRVPVIVEKAPKARIGDLDKKKYLVPSDLTVGQFYFLIRKRIHLRPEDALFFFVNNVIPPTSATMGSLYQEHHEEDYFLYIAYSDENVYGMAKIN

SEQ ID NO: 153 - DNA, 19 bp, Artificial Sequence
  Description of Artificial Sequence: CHEMICALLY SYNTHESIZED
cagcggggcccgcattgag

SEQ ID NO: 154 - DNA, 20 bp, Artificial Sequence
  Description of Artificial Sequence: CHEMICALLY SYNTHESIZED
cccggttatttgtagggccg

SEQ ID NO: 155 - DNA, 26 bp, Artificial Sequence
  Description of Artificial Sequence: CHEMICALLY SYNTHESIZED
agaattttccaggagtaggttcttgg

SEQ ID NO: 156 - DNA, 26 bp, Artificial Sequence
  Description of Artificial Sequence: CHEMICALLY SYNTHESIZED
acctttgaatgtcctgactatttggc

SEQ ID NO: 157 - DNA, 25 bp, Artificial Sequence
  Description of Artificial Sequence: CHEMICALLY SYNTHESIZED
gcgtagccgtagaggtgcacagaga

SEQ ID NO: 158 - DNA, 26 bp, Artificial Sequence
  Description of Artificial Sequence: CHEMICALLY SYNTHESIZED
caacacaggcgccaggttagctttac

SEQ ID NO: 159 - DNA, 20 bp, Artificial Sequence
  Description of Artificial Sequence: CHEMICALLY SYNTHESIZED
atgagccgccaattcaccta

SEQ ID NO: 160 - DNA, 21 bp, Artificial Sequence
  Description of Artificial Sequence: CHEMICALLY SYNTHESIZED
acctgctggcctccaattact

SEQ ID NO: 161 - DNA, 27 bp, Artificial Sequence
  Description of Artificial Sequence: CHEMICALLY SYNTHESIZED
tagctaacaagtactatgggagcccaa

SEQ ID NO: 162 - DNA, 27 bp, Artificial Sequence
  Description of Artificial Sequence: CHEMICALLY SYNTHESIZED
tgtagtttcatgttcttgtcaccaacc

SEQ ID NO: 163 - DNA, 19 bp, Artificial Sequence
  Description of Artificial Sequence: CHEMICALLY SYNTHESIZED
tcgtctccgtgggtgtggc

SEQ ID NO: 164 - DNA, 24 bp, Artificial Sequence
  Description of Artificial Sequence: CHEMICALLY SYNTHESIZED
ccaggacaggagggtttatgcaga

SEQ ID NO: 165 - DNA, 18 bp, Artificial Sequence
  Description of Artificial Sequence: CHEMICALLY SYNTHESIZED
atggcggacctgagcttc

SEQ ID NO: 166 - DNA, 24 bp, Artificial Sequence
  Description of Artificial Sequence: CHEMICALLY SYNTHESIZED
cttatccaagggcattatagacca

SEQ ID NO: 167 - DNA, 18 bp, Artificial Sequence
  Description of Artificial Sequence: CHEMICALLY SYNTHESIZED
atggcggacctgagcttc

SEQ ID NO: 168 - DNA, 24 bp, Artificial Sequence
  Description of Artificial Sequence: CHEMICALLY SYNTHESIZED
cttatccaagggcattatagacca

SEQ ID NO: 169 - DNA, 22 bp, Artificial Sequence
  Description of Artificial Sequence: CHEMICALLY SYNTHESIZED
cacagtggcttcttccttagtg

SEQ ID NO: 170 - DNA, 24 bp, Artificial Sequence
  Description of Artificial Sequence: CHEMICALLY SYNTHESIZED
catccaccgctccaatgagggtat

SEQ ID NO: 171 - DNA, 22 bp, Artificial Sequence
  Description of Artificial Sequence: CHEMICALLY SYNTHESIZED
atggtctttgttcatgcagttc

SEQ ID NO: 172 - DNA, 21 bp, Artificial Sequence
  Description of Artificial Sequence: CHEMICALLY SYNTHESIZED
cagtgccacagtggcttcttc

SEQ ID NO: 173 - DNA, 28 bp, Artificial Sequence
  Description of Artificial Sequence: CHEMICALLY SYNTHESIZED
agtgacaaccagcatacctgcatccacc

SEQ ID NO: 174 - DNA, 22 bp, Artificial Sequence
  Description of Artificial Sequence: CHEMICALLY SYNTHESIZED
tgcagttcataccctcattgga

SEQ ID NO: 175 - DNA, 22 bp, Artificial Sequence
  Description of Artificial Sequence: CHEMICALLY SYNTHESIZED
cacagtggcttcttccttagtg

SEQ ID NO: 176 - DNA, 26 bp, Artificial Sequence
  Description of Artificial Sequence: CHEMICALLY SYNTHESIZED
atacctgcatccaccgctccaatgag

SEQ ID NO: 177 - DNA, 22 bp, Artificial Sequence
  Description of Artificial Sequence: CHEMICALLY SYNTHESIZED
ggtctttgttcatgcagttcat

SEQ ID NO: 178 - DNA, 22 bp, Artificial Sequence
  Description of Artificial Sequence: CHEMICALLY SYNTHESIZED
actcttccaggaggttctcact

SEQ ID NO: 179 - DNA, 23 bp, Artificial Sequence
  Description of Artificial Sequence: CHEMICALLY SYNTHESIZED
ctgaccctgcagcaccacatgct

SEQ ID NO: 180 - DNA, 21 bp, Artificial Sequence
  Description of Artificial Sequence: CHEMICALLY SYNTHESIZED
gtggaattctctgcactggtt

SEQ ID NO: 181 - DNA, 22 bp, Artificial Sequence
  Description of Artificial Sequence: CHEMICALLY SYNTHESIZED
cctcaagtgtctgtatgatgca

SEQ ID NO: 182 - DNA, 26 bp, Artificial Sequence
  Description of Artificial Sequence: CHEMICALLY SYNTHESIZED
cagactcacgccagtgagacctctgt

SEQ ID NO: 183 - DNA, 21 bp, Artificial Sequence
  Description of Artificial Sequence: CHEMICALLY SYNTHESIZED
gttgttgtccatggacaggat

SEQ ID NO: 184 - DNA, 22 bp, Artificial Sequence
  Description of Artificial Sequence: CHEMICALLY SYNTHESIZED
gcgtgcacagaaagactttaaa

SEQ ID NO: 185 - DNA, 28 bp, Artificial Sequence
  Description of Artificial Sequence: CHEMICALLY SYNTHESIZED
tgatgaaacttttcaatttcctgtagca

SEQ ID NO: 186 - DNA, 22 bp, Artificial Sequence
  Description of Artificial Sequence: CHEMICALLY SYNTHESIZED
tgaaatgtagttttcggttgct

SEQ ID NO: 187 - DNA, 21 bp, Artificial Sequence
  Description of Artificial Sequence: CHEMICALLY SYNTHESIZED
actacccgcataacgaaaatg

SEQ ID NO: 188 - DNA, 26 bp, Artificial Sequence
  Description of Artificial Sequence: CHEMICALLY SYNTHESIZED
ccgtcccaaagaaatgtccttttgaa

SEQ ID NO: 189 - DNA, 21 bp, Artificial Sequence
  Description of Artificial Sequence: CHEMICALLY SYNTHESIZED
atccgttctaggggtggtaac

SEQ ID NO: 190 - DNA, 22 bp, Artificial Sequence
  Description of Artificial Sequence: CHEMICALLY SYNTHESIZED
ggcagctctgactctacagttc

SEQ ID NO: 191 - DNA, 28 bp, Artificial Sequence
  Description of Artificial Sequence: CHEMICALLY SYNTHESIZED
tgaaccatctaaagaaggcacctatcgg

SEQ ID NO: 192 - DNA, 22 bp, Artificial Sequence
  Description of Artificial Sequence: CHEMICALLY SYNTHESIZED
tcgccatccagtactactctct

SEQ ID NO: 193 - DNA, 22 bp, Artificial Sequence
  Description of Artificial Sequence: CHEMICALLY SYNTHESIZED
ttggcttattccatgtccttta

SEQ ID NO: 194 - DNA, 26 bp, Artificial Sequence
  Description of Artificial Sequence: CHEMICALLY SYNTHESIZED
tatgcttttgcttctgacttggccct

SEQ ID NO: 195 - DNA, 22 bp, Artificial Sequence
  Description of Artificial Sequence: CHEMICALLY SYNTHESIZED
aacagaaatcccagaaggatgt

SEQ ID NO: 196 - DNA, 22 bp, Artificial Sequence
  Description of Artificial Sequence: CHEMICALLY SYNTHESIZED
accattgtcccttccattaaag

SEQ ID NO: 197 - DNA, 30 bp, Artificial Sequence
  Description of Artificial Sequence: CHEMICALLY SYNTHESIZED
tccagtcttttcagtgtcttcatcttcctg

SEQ ID NO: 198 - DNA, 22 bp, Artificial Sequence
  Description of Artificial Sequence: CHEMICALLY SYNTHESIZED
aagaaggcatcccaagtagaag

SEQ ID NO: 199 - DNA, 22 bp, Artificial Sequence
  Description of Artificial Sequence: CHEMICALLY SYNTHESIZED
ggttatgcacattcggaaacta

SEQ ID NO: 200 - DNA, 26 bp, Artificial Sequence
  Description of Artificial Sequence: CHEMICALLY SYNTHESIZED
tggatcgtccaaatggtctttatcca

SEQ ID NO: 201 - DNA, 22 bp, Artificial Sequence
  Description of Artificial Sequence: CHEMICALLY SYNTHESIZED
cctgttctggggttcaaataat

SEQ ID NO: 202 - DNA, 22 bp, Artificial Sequence
  Description of Artificial Sequence: CHEMICALLY SYNTHESIZED
catgttcagcattgtcaacttc

SEQ ID NO: 203 - DNA, 25 bp, Artificial Sequence
  Description of Artificial Sequence: CHEMICALLY SYNTHESIZED
atcattgccacactgctcatgctca

SEQ ID NO: 204 - DNA, 20 bp, Artificial Sequence
  Description of Artificial Sequence: CHEMICALLY SYNTHESIZED
catcatggcgatgaacaagt

SEQ ID NO: 205 - DNA, 22 bp, Artificial Sequence
  Description of Artificial Sequence: CHEMICALLY SYNTHESIZED
ggacgccttattcttctttgtc

SEQ ID NO: 206 - DNA, 26 bp, Artificial Sequence
  Description of Artificial Sequence: CHEMICALLY SYNTHESIZED
atccctcccactagtgctaccatggg

SEQ ID NO: 207 - DNA, 22 bp, Artificial Sequence
  Description of Artificial Sequence: CHEMICALLY SYNTHESIZED
tcttcctcatgactgtcctcat

SEQ ID NO: 208 - DNA, 22 bp, Artificial Sequence
  Description of Artificial Sequence: CHEMICALLY SYNTHESIZED
atggtatctcccattccagaac

SEQ ID NO: 209 - DNA, 26 bp, Artificial Sequence
  Description of Artificial Sequence: CHEMICALLY SYNTHESIZED
caattcccctcgaagatccaagtcat

SEQ ID NO: 210 - DNA, 22 bp, Artificial Sequence
  Description of Artificial Sequence: CHEMICALLY SYNTHESIZED
aaggatccgaattgctaagttc

SEQ ID NO: 211 - DNA, 22 bp, Artificial Sequence
  Description of Artificial Sequence: CHEMICALLY SYNTHESIZED
atggtatctcccattccagaac

SEQ ID NO: 212 - DNA, 26 bp, Artificial Sequence
  Description of Artificial Sequence: CHEMICALLY SYNTHESIZED
caattcccctcgaagatccaagtcat

SEQ ID NO: 213 - DNA, 22 bp, Artificial Sequence
  Description of Artificial Sequence: CHEMICALLY SYNTHESIZED
aaggatccgaattgctaagttc

SEQ ID NO: 214 - DNA, 20 bp, Artificial Sequence
  Description of Artificial Sequence: CHEMICALLY SYNTHESIZED
agacattccaggggacagaa

SEQ ID NO: 215 - DNA, 23 bp, Artificial Sequence
  Description of Artificial Sequence: CHEMICALLY SYNTHESIZED
cattcgatccctccctgctgctg

SEQ ID NO: 216 - DNA, 22 bp, Artificial Sequence
  Description of Artificial Sequence: CHEMICALLY SYNTHESIZED
caaagaggagggagcagactac

SEQ ID NO: 217 - DNA, 22 bp, Artificial Sequence
  Description of Artificial Sequence: CHEMICALLY SYNTHESIZED
tgggtatgaatgtgtgagttca

SEQ ID NO: 218 - DNA, 26 bp, Artificial Sequence
  Description of Artificial Sequence: CHEMICALLY SYNTHESIZED
agaggcctgctctcctcacacattgt

SEQ ID NO: 219 - DNA, 22 bp, Artificial Sequence
  Description of Artificial Sequence: CHEMICALLY SYNTHESIZED
gtgtctccctccatcattaacc

SEQ ID NO: 220 - DNA, 22 bp, Artificial Sequence
  Description of Artificial Sequence: CHEMICALLY SYNTHESIZED
aaggggaagtccaaaacaatac

SEQ ID NO: 221 - DNA, 26 bp, Artificial Sequence
  Description of Artificial Sequence: CHEMICALLY SYNTHESIZED
ctttattaccagaccctctgctgcgg

SEQ ID NO: 222 - DNA, 22 bp, Artificial Sequence
  Description of Artificial Sequence: CHEMICALLY SYNTHESIZED
atggtgagagagccttcataca

SEQ ID NO: 223 - DNA, 22 bp, Artificial Sequence
  Description of Artificial Sequence: CHEMICALLY SYNTHESIZED
ctatcgtgaggttcagctgatg

SEQ ID NO: 224 - DNA, 26 bp, Artificial Sequence
  Description of Artificial Sequence: CHEMICALLY SYNTHESIZED
aagcttctgaaccatccacacatcat

SEQ ID NO: 225 - DNA, 22 bp, Artificial Sequence
  Description of Artificial Sequence: CHEMICALLY SYNTHESIZED
cctttgtttccataacctggta

SEQ ID NO: 226 - DNA, 22 bp, Artificial Sequence
  Description of Artificial Sequence: CHEMICALLY SYNTHESIZED
tcagctgatgaagcttctgaac

SEQ ID NO: 227 - DNA, 28 bp, Artificial Sequence
  Description of Artificial Sequence: CHEMICALLY SYNTHESIZED
catccacacatcataaagctttaccagg

SEQ ID NO: 228 - DNA, 22 bp, Artificial Sequence
  Description of Artificial Sequence: CHEMICALLY SYNTHESIZED
cgatgtaaagcatgtcctttgt

SEQ ID NO: 229 - DNA, 22 bp, Artificial Sequence
  Description of Artificial Sequence: CHEMICALLY SYNTHESIZED
aggttcagctgatgaagcttct

SEQ ID NO: 230 - DNA, 29 bp, Artificial Sequence
  Description of Artificial Sequence: CHEMICALLY SYNTHESIZED
ccatccacacatcataaagctttaccagg

SEQ ID NO: 231 - DNA, 22 bp, Artificial Sequence
  Description of Artificial Sequence: CHEMICALLY SYNTHESIZED
cgatgtaaagcatgtcctttgt

SEQ ID NO: 232 - DNA, 21 bp, Artificial Sequence
  Description of Artificial Sequence: CHEMICALLY SYNTHESIZED
aaaattgacaggcgcatactt

SEQ ID NO: 233 - DNA, 26 bp, Artificial Sequence
  Description of Artificial Sequence: CHEMICALLY SYNTHESIZED
aaagcaaactggctttgttcctcctg

SEQ ID NO: 234 - DNA, 22 bp, Artificial Sequence
  Description of Artificial Sequence: CHEMICALLY SYNTHESIZED
tccaagatggtgaacattttct

SEQ ID NO: 235 - DNA, 22 bp, Artificial Sequence
  Description of Artificial Sequence: CHEMICALLY SYNTHESIZED
acgggtactaccagaccacact

SEQ ID NO: 236 - DNA, 26 bp, Artificial Sequence
  Description of Artificial Sequence: CHEMICALLY SYNTHESIZED
cctgccattgtcttccagatgtttga

SEQ ID NO: 237 - DNA, 22 bp, Artificial Sequence
  Description of Artificial Sequence: CHEMICALLY SYNTHESIZED
tctgagcagcaacttgaagatt

SEQ ID NO: 238 - DNA, 20 bp, Artificial Sequence
  Description of Artificial Sequence: CHEMICALLY SYNTHESIZED
agcaccatccacagctgctt

SEQ ID NO: 239 - DNA, 23 bp, Artificial Sequence
  Description of Artificial Sequence: CHEMICALLY SYNTHESIZED
ctcatcagagagcccctgcgtgc

SEQ ID NO: 240 - DNA, 21 bp, Artificial Sequence
  Description of Artificial Sequence: CHEMICALLY SYNTHESIZED
tgaccctcatccatggctact

SEQ ID NO: 241 - DNA, 22 bp, Artificial Sequence
  Description of Artificial Sequence: CHEMICALLY SYNTHESIZED
gtctgtctccttcatggtgaaa

SEQ ID NO: 242 - DNA, 26 bp, Artificial Sequence
  Description of Artificial Sequence: CHEMICALLY SYNTHESIZED
agctggtggaatcctcacactgttca

SEQ ID NO: 243 - DNA, 20 bp, Artificial Sequence
  Description of Artificial Sequence: CHEMICALLY SYNTHESIZED
tagccgtagaggtgcacaga

SEQ ID NO: 244 - DNA, 22 bp, Artificial Sequence
  Description of Artificial Sequence: CHEMICALLY SYNTHESIZED
cgatcatgtactgaacgtagca

SEQ ID NO: 245 - DNA, 25 bp, Artificial Sequence
  Description of Artificial Sequence: CHEMICALLY SYNTHESIZED
ctgccgattcctcaggtgctcttct

SEQ ID NO: 246 - DNA, 22 bp, Artificial Sequence
  Description of Artificial Sequence: CHEMICALLY SYNTHESIZED
aagatgaagcgcagctgtataa

SEQ ID NO: 247 - DNA, 21 bp, Artificial Sequence
  Description of Artificial Sequence: CHEMICALLY SYNTHESIZED
agcctacgctgaagagttagc

SEQ ID NO: 248 - DNA, 26 bp, Artificial Sequence
  Description of Artificial Sequence: CHEMICALLY SYNTHESIZED
aagccgaggtctcaatataatcctga

SEQ ID NO: 249 - DNA, 20 bp, Artificial Sequence
  Description of Artificial Sequence: CHEMICALLY SYNTHESIZED
acctgcaacttctcctcgtt

SEQ ID NO: 250 - DNA, 22 bp, Artificial Sequence
  Description of Artificial Sequence: CHEMICALLY SYNTHESIZED
gacgttggcatcttggtaaata

SEQ ID NO: 251 - DNA, 26 bp, Artificial Sequence
  Description of Artificial Sequence: CHEMICALLY SYNTHESIZED
cgcagtatttcactcagctgtccgag

SEQ ID NO: 252 - DNA, 22 bp, Artificial Sequence
  Description of Artificial Sequence: CHEMICALLY SYNTHESIZED
ttatgatgtcccagagcttgtc

SEQ ID NO: 253 - DNA, 639 bp, Homo sapiens
ggatccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacaccataaagctttaccaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccatcacatcgtccaccgggacctcaagaccgagaacctcctgctggatggcaacatggacatcaagctggcagattttggatttgggaatttctacaagtcaggagagcctctgtccacgtggtgtgggagccccccgtatgccgccccggaagtctttgaggggaaggagtatgaaggcccccagctggacatctggagcctcgag

SEQ ID NO: 254 - DNA, 639 bp, Homo sapiens
ggatccatggttatcatgtcggagttcagcgcggaccccgcgggccagggtcagggccagcagaagcccctccgggtgggtttttacgacatcgagcggaccctgggcaaaggcaacttcgcggtggtgaagctggcgcggcatcgagtcaccaaaacgcaggttgcaataaaaataattgataaaacacgattagattcaagcaatttggagaaaatctatcgtgaggttcagctgatgaagcttctgaaccatccacacatcataaagctttaccaggttatggaaacaaaggacatgctttacatcgtcactgaatttgctaaaaatggagaaatgtttgattatttgacttccaacgggcacctgagtgagaacgaggcgcggaagaagttctggcaaatcctgtcggccgtggagtactgtcacgaccattacatcgtccaccgggacctcaagaccgagaacctcctgctggatggcaacatggacatcaagctggcagattttggatttgggaatttctacaagtcaggagagcctctgtccacgtggtgtgggagccccccgtatgccgccccggaagtctttgaggggaaggagtatgaaggcccccagctggacatctggagcctcgag

SEQ ID NO: 255 - DNA, 324 bp, Homo sapiens
ggatcctatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtaatgagagtgtctatgggctcgag

SEQ ID NO: 256 - DNA, 324 bp, Homo sapiens
ggatcctatcggaaaaaggaaggagaaaagatccagaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtaatgagagtgtctatgggctcgag

SEQ ID NO: 257 - protein, 188 aa, Homo sapiens
TDGIGKAYAEELASRGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLH

SEQ ID NO: 258 - protein, 186 aa, Homo sapiens
SSGIGLAIAKRLAEEGAKVVVVDRREEKAEAAAELKAELGDRALFIQLDVTDEESIKAAVAQAVEELGRLDVLVNNAGILGPGEPFELSEDDWERVIDVNLTGVFLLTQAVLPHMLKRSGGRIVNISSVAGLVPSPGLSAYSASKAAVVGFTRSLALELAPHGIRVNAIAPGGVDTDMTKALRSIA

SEQ ID NO: 259 - protein, 315 aa, Homo sapiens
QEREQIKVLNNKFASFIDKVRFLEQQNQVLETKWELLQQLDLNNCKNNLEPILEGYISNLRKQLETLSGDRVRLDSELRSVREVVEDYKKRYEEEINKRTTAENEFVVLKKDVDAAYTSKVELQAKVDALDGEIKFFKCLFPLQETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGALHQAKEELARMLREYQELMSLKLALDMEIATYRKLLESEECR

SEQ ID NO: 260 - protein, 312 aa, Homo sapiens
NEKEQMQNLNDRLASYIDKVRFLEQQNKELEVKIEELRQKQAPSVSRLYSLYETEIEELRRQIDQLTNERARLQLEIDNLREAAEDFRKKYEDEINLRQEAENDLVGLRKDLDEATLARVDLENKVESLQEELEFLKKNHEEEVKELQAQIQDTVNVEMDAARKLDLTKALREIRAQYEEIAKKNRQEAEEWYKSKLEELQTAAARNGEALRSAKEEITELRRQIQSLEIELQSLKAQNASLERQLAELEERYELELRQYQALISQLEEELQQLREEMARQLREYQELLDVKLALDIEIATYRKLLEGEESR

SEQ ID NO: 261 - protein, 318 aa, Homo sapiens
QKVRAQEREQIKVLNNKFASFIDKVRFLEQQNQVLETKWELLQQLDLNNCKNNLEPILEGYISNLRKQLETLSGDRVRLDSELRSVREVVEDYKKRYEEEINKRTTAENEFVVLKKDVDAAYTSKVELQAKVDALDGEIKFFKCLFPLQETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGALHQAKEELARMLREYQELMSLKLALDMEIATYRKLLESEE

SEQ ID NO: 262 - protein, 336 aa, Homo sapiens
EKKAKQLESQLSELQVKLDELQRQLNDLTSQKSRLQSENSDLTRQLEEAEAQVSNLSKLKSQLESQLEEAKRSLEEESRERANLQAQLRQLEHDLDSLREQLEEESEAKAELERQLSKANAEIQQWRSKFESEGALRAEELEELKKKLNQKISELEEAAEAANAKCDSLEKTKSRLQSELEDLQIELERANAAASELEKKQKNFDKILAEWKRKVDELQAELDTAQREARNLSTELFRLKNELEELKDQVEALRRENKNLQDEIHDLTDQLGEGGRNVHELEKARRRLEAEKDELQAALEEAEAALELEESKVLRAQVELSQIRSEIERRLAEKEE

SEQ ID NO: 263 - protein, 222 aa, Homo sapiens
LEGYISNLRKQLETLSGDRVRLDSELRSVREVVEDYKKRYEEEINKRTTAENEFVVLKKDVDAAYTSKVELQAKVDALDGEIKFFKCLFPLQETAQIQSHISDTSIILSMDNNRNLDLDSIIAEVRAQYEEIARKSKAEAEALYQTKFQELQLAAGRHGDDLKHTKNEISELTRLIQRLRSEIESVKKQCANLETAIADAEQRGDCALKDARAKLDELEGAL

SEQ ID NO: 264 - protein, 209 aa, Homo sapiens
LEGDINELEIALDHANKANAEAQKNVKKYQQQVKELQTQVEEEQRAREDAREQLAVAERRATALEAELEELRSALEQAERARKQAETELAEASERVNELTAQNSSLIAQKRKLEGELAALQSDLDEAVNELKAAEERAKKAQADAARLAEELRQEQEHSQHLERLRKQLESQVKELQVRLDEAEAAALKGGKKMIQKLEARVRELEAEL

SEQ ID NO: 265 - protein, 230 aa, Homo sapiens
YDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIR

SEQ ID NO: 266 - protein, 234 aa, Homo sapiens
YELLEVLGKGAFGKVYLARDKKTGKLVAIKVIKKEKLKKKKRERILREIKILKKLDHPNIVKLYDVFEDDDKLYLVMEYCEGGDLFDLLKKRGRLSEDEARFYARQILSALEYLHSQGIIHRDLKPENILLDSDGHVKLADFGLAKQLDSGGTLLTTFVGTPEYMAPEVLLGKGYGKAVDIWSLGVILYELLTGKPPFPGDDQLLALFKKIGKPPPPFPPPEWKISPEAKDLIK

SEQ ID NO: 267 - protein, 230 aa, Homo sapiens; identical to SEQ ID NO: 265

SEQ ID NO: 268 - protein, 234 aa, Homo sapiens
YELGEKLGSGAFGKVYKGKHKDTGEIVAIKILKKRSLSEKKKRFLREIQILRRLSHPNIVRLLGVFEEDDHLYLVMEYMEGGDLFDYLRRNGLLLSEKEAKKIALQILRGLEYLHSRGIVHRDLKPENILLDENGTVKIADFGLARKLESSSYEKLTTFVGTPEYMAPEVLEGRGYSSKVDVWSLGVILYELLTGKLPFPGIDPLEELFRIKERPRLRLPLPPNCSEELKDLIK

SEQ ID NO: 269 - protein, 228 aa, Homo sapiens
IERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIR

SEQ ID NO: 270 - protein, 236 aa, Homo sapiens
LGKKLGEGAFGEVYKGTLKGKGGVEVEVAVKTLKEDASEQQIEEFLREARLMRKLDHPNIVKLLGVCTEEEPLMIVMEYMEGGDLLDYLRKNRPKELSLSDLLSFALQIARGMEYLESKNFVHRDLAARNCLVGENKTVKIADFGLARDLYDDDYYRKKKSPRLPIRWMAPESLKDGKFTSKSDVWSFGVLLWEIFTLGESPYPGMSNEEVLEYLKKGYRLPQPPNCPDEIYDLML

SEQ ID NO: 271 - protein, 379 aa, Homo sapiens
EVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKEVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLN

SEQ ID NO: 272 - protein, 410 aa, Homo sapiens
NVKYGVVIDAGSSGTRLHVYKWKDEDLDLLQIVPLIEEFKKLEPGLSSFATKPEEAAKYLTPLLEFAEEVIPDSQLSETPVFLGATAGMRLLPEDASEKILRALRNGLKSLSTFPVDDQGVRIIDGAEEGLYGWITVNYLLGRFGKDPEQCRQSTVGVIDLGGASTQIAFEPQEGFVIASKVEDGNLYLQQERLYGEKYDVYVHSFLGYGANEALRKYLAKLISNLSNLILSDPCLPPGFNKTVSYSEVEFDVFAIRGTGNWEQCSNSIRELLNKNAVCPYEQCTFNGVHAPSIGALQKNIGASSYFYTTGDFFGLVGEYEVASPEKLTDKAKEACSKNWEDIKSGYPKTLDKNVSEEYACFDLAYILSLLHDGFSLDPTSELIQSVKKIAGSEAGWTLGAMLYLTNALP

SEQ ID NO: 273 - protein, 437 aa, Homo sapiens
YSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQL

SEQ ID NO: 274 - protein, 423 aa, Homo sapiens
IHSLTELRKKYGPVFTLYLGPRPVVVVTGPEAVKEVLIDKGEEFAGRGDFPVFPWLGYGILFSNGPRWRQLRRLLTLRFFGMGKRSKLEERIQEEARDLVERLRKEQGSPIDITELLAPAPLNVICSLLFGVRFDYEDPEFLKLIDKLNELFFLVSPWGQLLDFFRYLPGSHRKAFKAAKDLKDYLDKLIEERRETLEPGDPRDFLDSLLIEAKREGGSELTDEELKATVLDLLFAGTDTTSSTLSWALYLLAKHPEVQAKLREEIDEVIGRDRSPTYDDRANMPYLDAVIKETLRLHPVVPLLLPRVATEDTEIDGYLIPKGTLVIVNLYSLHRDPKVFPNPEEFDPERFLDENGKFKKSYAFLPFGAGPRNCLGERLARMELFLFLATLLQRFELELVPPGDIPLTPKPLGLPSKPPLYQL

SEQ ID NO: 275 - protein, 164 aa, Homo sapiens
YFGKTILGGPFHVIMITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFAIIATLLMLNLFIAMM

SEQ ID NO: 276 - protein, 167 aa, Homo sapiens
GFKLKYLRSPWNILDFLIVLPSLIDLILFLSGGGSVLRLLRLLRLLRLLRRLEGLRTLLQSLGRSLKSLLNLLLLLLLLLFIFAIIGVQLFGGEFNKCCDGVNPINGNSNFDSFGEAFYWLFRTLTTEGWGDIMPDTLDAPVLGKIFFVIFIILGGLLLLNLFIAVI

SEQ ID NO: 277 - protein, 31 aa, Homo sapiens
GEHPLSFAACVNSEEIVRLLIEHGADIRAQD

SEQ ID NO: 278 - protein, 31 aa, Homo sapiens
GNTPLHLAARNGHLEVVKLLLEAGADVNARD

SEQ ID NO: 279 - protein, 30 aa, Homo sapiens
GQTALHIAVVNQNVNLVRALLTRRASVSAR

SEQ ID NO: 280 - protein, 30 aa, Homo sapiens
GNTPLHLAARNGHLEVVKLLLEAGADVNAR

SEQ ID NO: 281 - protein, 72 aa, Homo sapiens
FQTEDPTSLGQFYDYPMALFTTFELFLTVIDAPANYDVDLPFMFSIVNFAFAIIATLLMLNLFIAMMGDTHW

SEQ ID NO: 282 - protein, 73 aa, Homo sapiens
FYERALESLDIYKEIYVSAFVSIPLFVVFVILVPSLLGANFVAMFTISLFAIPALSLLLVLLIKLRVPIDPIW

SEQ ID NO: 283 - protein, 218 aa, Homo sapiens
LVFPDANGEYQSPINLNSREARYDPSLLDVRLSPNYVVCRDCEVTNDGHTIQVILKSKSVLSGGPLPQGHEFELYEVRFHWGRENQRGSEHTVNFKAFPMEIGKEHVGLKAVTEILQDIQYKGKSKTIPCFNPNTLLPDPLLRDYWVYEGSLTIPPCSEGVTWILFRYPLTISQLQIEEFRRLRTHVKGAELVEGCDGILGDNFRPTQPLSDRVIRAA

SEQ ID NO: 284 - protein, 242 aa, Homo sapiens
LLYPIAGGDRQSPINIQTKKARYDPSLKPLSVSYYAATAKEITNNGHSVQVEFDDSMDKSVLSGGPLPAPYRLKQFHFHWGSSNEHGSEHTVDGVKYPAELHLVHWNSTKYGSYKEAQKKPDGLAVLGVFVKVGAENPGLQKLVDALQNIKTKGKSATFTNFDPSDLLPALRDYWTYPGSLTTPPCTESVTWIVLKEPITVSSEQLEKFRSLLFSVEGEEEVPMVDNYRPTQPLKGRVVRAS

SEQ ID NO: 285 - protein, 103 aa, Homo sapiens
RKKEGEKIRKKYPDRVPLIVEKAPKARVPDLDRRKYLVPSDLTDGQFYLLIRKRIHLRPEDALFFFVNNTIPPTSATMGQLYEDSHEEDDFLYVAYSNESVYG

SEQ ID NO: 286 - protein, 103 aa, Homo sapiens
RRAESERIREKYPDRIPVIVEKAEKSDLPDIDKKKYLVPADLTVGQFVYIIRKRIQLSPEKAIFLFVNNTLPPTSATMSALYEEEKDEDGFLYMVYSGENTFG

SEQ ID NO: 287 - protein, 291 aa, Homo sapiens [sequence omitted]

SEQ ID NO: 288 - protein, 213 aa, Homo sapiens
GSMVIMSEFSADPAGQGQGQQKPLRVGFYDIERTLGKGNFAVVKLARHRVTKTQVAIKIIDKTRLDSSNLEKIYREVQLMKLLNHPHTIKLYQVMETKDMLYIVTEFAKNGEMFDYLTSNGHLSENEARKKFWQILSAVEYCHDHHIVHRDLKTENLLLDGNMDIKLADFGFGNFYKSGEPLSIWCGSPPYAAPEVFEGKEYEGPQLDIWSLE

SEQ ID NO: 289 - protein, 213 aa, Homo sapiens
GSMVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHYIVHRDLKTENLLLDGNMDIKLADFGFGNFYKSGEPLSIWCGSPPYAAPEVFEGKEYEGPQLDIWSLE

SEQ ID NO: 290 - protein, 108 aa, Homo sapiens
GSYRKKEGEKIRKKYPDRVPVIVEKAPKARVPDLDKRKYLVPSDLTVGQFYFLIRKRIHLRPEDALFFFVNNTIPPTSATMGQLYEDNHEEDYFLYVAYSNESVYGLE

SEQ ID NO: 291 - protein, 108 aa, Homo sapiens
GSYRKKEGEKIQKKYPDRVPVIVEKAPKARVPDLDKRKYLVPSDLTVGQFYFLIRKRIHLRPEDALFFFVNNTIPPTSATMGQLYEDNHEEDYFLYVAYSNESVYGLE

SEQ ID NO: 292 - protein, 117 aa, Homo sapiens; identical to SEQ ID NO: 50

What is claimed is:

1. An isolated nucleic acid molecule comprising a nucleic acid sequence encoding a polypeptide comprising the amino acid sequence of SEQ ID NO: 12.

2. The nucleic acid molecule of claim 1, wherein the nucleic acid molecule comprises the nucleotide sequence encoding the polypeptide consisting of amino acid sequence SEQ ID NO: 12.

3. The nucleic acid molecule of claim 1, wherein said nucleic acid molecule comprises the nucleotide sequence of SEQ ID NO: 11.

4. The nucleic acid molecule of claim 1, wherein the nucleic acid molecule consists of a nucleotide sequence of SEQ ID NO: 11.

5. A vector comprising the nucleic acid molecule of claim 1.

6. The vector of claim 5, further comprising a promoter operably-linked to said nucleic acid molecule.

7. An isolated cell comprising the vector of claim 5.

8. A method for determining the presence or amount of the nucleic acid molecule of claim 1 in a sample, the method comprising:
   (a) providing the sample;
   (b) contacting the sample with a probe that binds to said nucleic acid molecule; and
   (c) determining the presence or amount of the probe bound to said nucleic acid molecule thereby determining the presence or amount of the nucleic acid molecule in a sample.

9. A composition comprising the nucleic acid molecule of claim 1 and a pharmaceutically-acceptable carrier.

10. A kit comprising in one or more containers, the composition of claim 9.

11. A method for determining the presence or predisposition to a disease associated with altered levels of the nucleic acid molecule of claim 1 in a first mammalian subject, the method comprising:
   (a) measuring the amount of a nucleic acid in a sample from the first mammalian subject; and
   (b) comparing the amount of said nucleic acid in the sample of step (a) to the amount of the nucleic acid present in the control sample from a second mammalian subject known not to have or not to be predisposed to the disease; wherein an alteration in the level of the nucleic acid in the first subject as compared to the control sample indicates the presence of or predisposition to the disease.

12. An isolated nucleic acid molecule comprising a nucleotide sequence that is a complement of the nucleotide sequence of claim 1.

* * * * *